(12) United States Patent
Anthony et al.

(10) Patent No.: US 9,267,157 B2
(45) Date of Patent: Feb. 23, 2016

(54) BUTANOL STRAIN IMPROVEMENT WITH INTEGRATION OF A POLYNUCLEOTIDE ENCODING A POLYPEPTIDE THAT CATALYZES PYRUVATE TO ACETOLACTATE CONVERSION

(75) Inventors: Larry Cameron Anthony, Aston, PA (US); Lori Ann Maggio-Hall, Wilmington, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 0 days.

(21) Appl. No.: 13/227,016

(22) Filed: Sep. 7, 2011

(65) Prior Publication Data
US 2012/0237988 A1 Sep. 20, 2012

Related U.S. Application Data

(60) Provisional application No. 61/466,557, filed on Mar. 23, 2011, provisional application No. 61/380,563, filed on Sep. 7, 2010.

(51) Int. Cl.
| | |
|---|---|
| C12P 7/16 | (2006.01) |
| C12N 9/20 | (2006.01) |
| C12N 1/20 | (2006.01) |
| C12N 1/00 | (2006.01) |
| C12N 1/12 | (2006.01) |
| C07H 21/04 | (2006.01) |
| C12N 9/04 | (2006.01) |
| C12N 9/10 | (2006.01) |
| C12N 9/88 | (2006.01) |
| C12N 15/52 | (2006.01) |
| C12P 7/18 | (2006.01) |
| C12P 7/26 | (2006.01) |
| C12P 7/64 | (2006.01) |

(52) U.S. Cl.
CPC ............ *C12P 7/16* (2013.01); *C12N 9/0006* (2013.01); *C12N 9/1022* (2013.01); *C12N 9/88* (2013.01); *C12N 15/52* (2013.01); *C12P 7/18* (2013.01); *C12P 7/26* (2013.01); *C12P 7/649* (2013.01); *C12Y 101/01001* (2013.01); *C12Y 101/01002* (2013.01); *C12Y 101/01086* (2013.01); *C12Y 101/01265* (2013.01); *C12Y 202/01006* (2013.01); *C12Y 401/01001* (2013.01); *C12Y 401/01072* (2013.01); *C12Y 402/01009* (2013.01); *Y02E 50/10* (2013.01); *Y02E 50/13* (2013.01)

(58) Field of Classification Search
None
See application file for complete search history.

(56) References Cited

U.S. PATENT DOCUMENTS

| | | |
|---|---|---|
| 4,683,202 A | 7/1987 | Mullis |
| 6,432,688 B1 | 8/2002 | Ito et al. |
| 7,541,173 B2 | 6/2009 | Bramucci et al. |
| 7,659,104 B2 | 2/2010 | Bramucci et al. |
| 7,851,188 B2 | 12/2010 | Donaldson et al. |
| 7,910,342 B2 | 3/2011 | Liao et al. |
| 7,993,889 B1 | 8/2011 | Donaldson et al. |
| 8,017,364 B2 | 9/2011 | Bramucci et al. |
| 8,129,162 B2 | 3/2012 | Li et al. |
| 8,178,328 B2 | 5/2012 | Donaldson et al. |
| 8,188,250 B2 | 5/2012 | Bramucci et al. |
| 8,206,970 B2 | 6/2012 | Eliot et al. |
| 8,222,017 B2 | 7/2012 | Li et al. |
| 8,241,878 B2 | 8/2012 | Anthony et al. |
| 8,273,558 B2 | 9/2012 | Donaldson et al. |
| 8,283,144 B2 | 10/2012 | Donaldson et al. |
| 8,372,612 B2 | 2/2013 | Larossa et al. |
| 8,389,252 B2 | 3/2013 | Larossa |
| 8,455,224 B2 | 6/2013 | Paul |
| 8,455,225 B2 | 6/2013 | Bramucci et al. |
| 8,465,964 B2 | 6/2013 | Anthony et al. |
| 8,518,678 B2 | 8/2013 | Flint et al. |
| 8,557,562 B2 | 10/2013 | Bramucci et al. |
| 8,614,085 B2 | 12/2013 | Van Dyk et al. |
| 8,637,281 B2 | 1/2014 | Paul et al. |
| 8,637,289 B2 | 1/2014 | Anthony et al. |
| 8,652,823 B2 | 2/2014 | Flint et al. |
| 8,669,094 B2 | 3/2014 | Anthony et al. |
| 8,691,540 B2 | 4/2014 | Bramucci et al. |
| 8,735,114 B2 | 5/2014 | Donaldson et al. |
| 8,765,433 B2 | 7/2014 | Gude et al. |
| 8,785,166 B2 | 7/2014 | Anthony et al. |
| 8,795,992 B2 | 8/2014 | Bramucci et al. |
| 8,828,694 B2 | 9/2014 | Anthony et al. |
| 8,828,704 B2 | 9/2014 | Donaldson et al. |
| 8,871,488 B2 | 10/2014 | Dauner et al. |

(Continued)

FOREIGN PATENT DOCUMENTS

| | | |
|---|---|---|
| WO | WO 2010075504 | 7/2010 |
| WO | WO 2011041415 | 4/2011 |

(Continued)

OTHER PUBLICATIONS

Fukuda et al. Biodiesel fuel production by transesterification of oils, Journal of Bioscience and Bioengineering (2001), 92: 405-416.*
Aden, et al., Lignocellulosic Biomass to Ethanol Process Design and Economics Utilizing Co-Current Dilute Acid Prehydrolysis and Enzymatic Hydrolysis for Corn Stover, National Renewable Energy Laboratory, Technical Report NREL/TP-510-32438, Jun. 2002.
Akada, et al., PCR-mediated seamless gene deletion and marker recycling in Saccharomyces cerevisiae, Yeast 23:399-405, 2006.

(Continued)

*Primary Examiner* — Iqbal H Chowdhury

(57) ABSTRACT

The invention relates to recombinant host cells having at least one integrated polynucleotide encoding a polypeptide that catalyzes a step in a pyruvate-utilizing biosynthetic pathway, e.g., pyruvate to acetolactate conversion. The invention also relates to methods of increasing the biosynthetic production of isobutanol, 2,3-butanediol, 2-butanol or 2-butanone using such host cells.

7 Claims, 9 Drawing Sheets

(56) References Cited

U.S. PATENT DOCUMENTS

| | | | |
|---|---|---|---|
| 8,889,385 | B2 | 11/2014 | Donaldson et al. |
| 8,895,307 | B2 | 11/2014 | Li et al. |
| 8,906,666 | B2 | 12/2014 | Alsaker |
| 8,911,981 | B2 | 12/2014 | Li et al. |
| 8,940,511 | B2 | 1/2015 | Larossa |
| 8,945,859 | B2 | 2/2015 | Donaldson et al. |
| 8,945,899 | B2 | 2/2015 | Li et al. |
| 8,951,774 | B2 | 2/2015 | Donaldson et al. |
| 8,951,937 | B2 | 2/2015 | Flint et al. |
| 8,956,850 | B2 | 2/2015 | Anthony et al. |
| 8,962,298 | B2 | 2/2015 | Donaldson et al. |
| 8,969,065 | B2 | 3/2015 | Anthony et al. |
| 8,980,612 | B2 | 3/2015 | Donaldson et al. |
| 2005/0059136 | A1 | 3/2005 | Van Maris et al. |
| 2007/0031950 | A1 | 2/2007 | Winkler |
| 2007/0092957 | A1* | 4/2007 | Donaldson et al. ........... 435/157 |
| 2007/0259410 | A1 | 11/2007 | Donaldson et al. |
| 2007/0292927 | A1 | 12/2007 | Donaldson et al. |
| 2008/0182308 | A1 | 7/2008 | Donaldson et al. |
| 2008/0261230 | A1 | 10/2008 | Liao et al. |
| 2008/0261861 | A1 | 10/2008 | Sleep et al. |
| 2008/0274522 | A1 | 11/2008 | Bramucci et al. |
| 2008/0274525 | A1 | 11/2008 | Bramucci et al. |
| 2009/0155870 | A1 | 6/2009 | Donaldson et al. |
| 2009/0163376 | A1 | 6/2009 | Li et al. |
| 2009/0269823 | A1 | 10/2009 | Bramucci et al. |
| 2009/0305363 | A1 | 12/2009 | Anthony et al. |
| 2009/0305369 | A1* | 12/2009 | Donaldson et al. ........... 435/160 |
| 2009/0305370 | A1 | 12/2009 | Grady et al. |
| 2010/0081154 | A1 | 4/2010 | Flint et al. |
| 2010/0081179 | A1 | 4/2010 | Anthony et al. |
| 2010/0081182 | A1 | 4/2010 | Paul et al. |
| 2010/0093020 | A1 | 4/2010 | Bramucci et al. |
| 2010/0120105 | A1 | 5/2010 | Anthony et al. |
| 2010/0197519 | A1 | 8/2010 | Li et al. |
| 2010/0221802 | A1 | 9/2010 | Grady et al. |
| 2011/0020889 | A1 | 1/2011 | Feldman et al. |
| 2011/0097773 | A1 | 4/2011 | Grady et al. |
| 2011/0124060 | A1 | 5/2011 | Anthony et al. |
| 2011/0136192 | A1 | 6/2011 | Paul et al. |
| 2011/0195505 | A1 | 8/2011 | Euler et al. |
| 2011/0244536 | A1 | 10/2011 | Nagarajan et al. |
| 2011/0250610 | A1 | 10/2011 | Bramucci et al. |
| 2012/0015416 | A1 | 1/2012 | Anthony et al. |
| 2012/0058541 | A1 | 3/2012 | Alsaker et al. |
| 2012/0064561 | A1 | 3/2012 | Flint et al. |
| 2012/0149080 | A1 | 6/2012 | Bramucci et al. |
| 2012/0156735 | A1 | 6/2012 | Dauner et al. |
| 2012/0156738 | A1 | 6/2012 | Anton et al. |
| 2012/0196341 | A1 | 8/2012 | Donaldson et al. |
| 2012/0258873 | A1 | 10/2012 | Gibson et al. |
| 2013/0035515 | A1 | 2/2013 | Dobson et al. |
| 2013/0071898 | A1 | 3/2013 | Anthony et al. |
| 2013/0171706 | A1 | 7/2013 | Donaldson et al. |
| 2013/0203138 | A1 | 8/2013 | McElvain et al. |
| 2013/0252296 | A1 | 9/2013 | Maggio-Hall et al. |
| 2013/0316414 | A1 | 11/2013 | Paul et al. |
| 2014/0004526 | A1 | 1/2014 | Dauner et al. |
| 2014/0030782 | A1 | 1/2014 | Anthony et al. |
| 2014/0030783 | A1 | 1/2014 | Anthony et al. |
| 2014/0038263 | A1 | 2/2014 | Flint et al. |
| 2014/0038268 | A1 | 2/2014 | Flint et al. |
| 2014/0051133 | A1 | 2/2014 | Govindarajan et al. |
| 2014/0051137 | A1 | 2/2014 | Flint et al. |
| 2014/0057329 | A1 | 2/2014 | Li et al. |
| 2014/0093930 | A1 | 4/2014 | Li et al. |
| 2014/0096439 | A1 | 4/2014 | Bramucci et al. |
| 2014/0141479 | A1 | 5/2014 | Anthony et al. |
| 2014/0170732 | A1 | 6/2014 | Bramucci et al. |
| 2014/0186910 | A1 | 7/2014 | Rothman et al. |
| 2014/0186911 | A1 | 7/2014 | Anthony et al. |
| 2014/0273116 | A1 | 9/2014 | Kelly et al. |
| 2014/0273129 | A1 | 9/2014 | Bhalla et al. |
| 2014/0308735 | A1 | 10/2014 | Anthony et al. |
| 2014/0335582 | A1 | 11/2014 | Donaldson et al. |
| 2014/0349349 | A1 | 11/2014 | Dauner et al. |
| 2014/0377824 | A1 | 12/2014 | Satagopan et al. |
| 2015/0037855 | A1 | 2/2015 | Bhadra et al. |
| 2015/0111269 | A1 | 4/2015 | Li et al. |
| 2015/0119608 | A1 | 4/2015 | Donaldson et al. |
| 2015/0125920 | A1 | 5/2015 | Anthony et al. |

FOREIGN PATENT DOCUMENTS

| | | | |
|---|---|---|---|
| WO | WO 2011103300 | | 8/2011 |
| WO | WO-2012/033832 | * | 4/2012 |

OTHER PUBLICATIONS

Albert et al., Site-specific integration of DNA into wild-type and mutant lox sites placed in the plant genome, The Plant Journal 7:649-659, 1995.
Altschul, et al., Basic Local Alignment Search Tool, J. Mol. Biol. 215:403-410, 1990.
Ausubel, et al., Current Protocols in Molecular Biology, vol. 1, John Wiley & Sons, Inc., pp. 1.8.1-1.8.10, 1997.
Bellion, et al., Methylamine Utilization in Yeast and Bacteria: Studies Using in vivo NMR, Ed. Murrell, et al., Microbial Growth on C1 Compounds, Intercept Ltd., Andover, pp. 415-432, 1993.
Bianchi, et al., The petite-negative yeast *Kluyveromyces lactis* has a single gene expressing pyruvate decarboxylase activity, Mol. Microbiol. 19:27-36, 1996.
Boeke, et al., A positive selection for mutants lacking orotidine-5-phosphate decarboxylase activity in yeast: 5-fluro-orotic acid resistance, Mol. Gen. Genet. 197:345-346, 1984.
Christianson, et al., Multifunctional yeast high-copy-number shuttle vectors, Gene 110:119-122, 1992.
Deshpande, Ethanol production from cellulose by coupled saccharification/fermentation using saccharomyces cerevisiae and cellulose complex from sclerotium rolfsii UV-8 mutant, Appl. Biochem. Biotechnol. 36:227-234, 1992.
Flikweert, et al., Pyruvate decarboxylase: an indispensable enzyme for growth of saccharomyces cerevisiae on glucose, Yeast, 12:247-257, 1996.
Frohman, et al., Rapid production of full-length cDNAs from rare transcripts: Amplification using a single gene-specific oligonucleotide primer, Proc. Natl. Acad. Sci. USA 85:8998-9002, 1988.
Gollop, et al., Physiological implications of the substrate specificities of acetohydroxy acid synthases from varied organisms, J. Bacteriology 172:3444-3449, 1990.
Guo, et al., Pervaporation study on the dehydration of aqueous butanol solutions: a comparison of flux vs. permeance, separation factor vs. selectivity, J. Membrane Sci. 245:199-210, 2004.
Higgins, et al., Fast and sensitive multiple sequence alignments on a microcomputer, CABIOS Comm. 5:151-153, 1989.
Higgins, et al., Clustal V: improved software for multiple sequence alignment, CABIOS 8:189-191, 1992.
Hohmann, et al., Characterisation of PDC2, a gene necessary for high level expression of pyruvate decarboxylase structural genes in Saccharomyces cerevisiae, Mol Gen Genet. 241:657-666, 1993.
Holtzclaw, et al., Degradative acetolactate synthase of Bacillus subtilis: Purification and Properties, J. Bacteriology 121:917-922, 1975.
Ishida, et al., The effect of pyruvate decarboxylase gene knockout in Saccharomyces cerevisiae on L-Lactic acid production, Biosci. Biotech. Biochem. 70:1148-1153, 2006.
Jones, et al., 1-Aminopropan-2-ol and ethanolamine metabolism via propionaldehyde and acetaldehyde in a species of *Pseudomonas*, Biochem. J. 134:167-182, 1973.
Loh, et al., Polymerase chain reaction with single-sided specificity: analysis of T cell receptor delta chain, Science 243:217-220, 1989.
Ludwig, et al., High level heterologous gene expression in Saccharomyces cerevisiae from a stable 2um plasmid system, Gene 132:33-40, 1993.
Ma, et al., Plasmid construction by homologous recombination in yeast, Gene 58:201-216, 1987.
Methods in Yeast Genetics, 2005, Cold Spring Harbor Laboratory Press, Cold Spring Harbor, NY, pp. 201-202.

(56) References Cited

OTHER PUBLICATIONS

Nevoigt, et al., Reduced pyruvate decarboxylase and increased glycerol-3-phosphate dehydrogenase [NAD+] levels enhance glycerol production in Saccharomyces cerevisiae, Yeast 12:1331-1337, 1996.
Nevoigt, et al., Engineering of promoter replacement cassettes for fine tuning of gene expression Saccharomyces cerevisiae, Appl. Environ. Microbiol. 72:5266-5273, 2006.
Nystrom, et al., Reduction of organic compounds by lithium aluminum hydride, I. Aldehydes, ketones, esters, acid chlorides and acid hydrides J. Am. Chem. Soc., 69:1197-1199, 1947.
Ohara, et al., One-sided polymerase chain reaction: The amplification of cDNA, Proc. Natl. Acad. Sci. USA 86:5673-5677, 1989.
Pearson, Searching protein sequence databases-is optimal best?, Computational Methods Genome Research, [Proc. Int. Symp.] (1994), Meeting Date 1992, 111-20. Editor(s): Suhai, Sandor. Plenum: New York, NY.
Romanos, et al., Direct selection of stabilized yeast URA3 transformants with 5-fluorouracil, Nucleic Acids Research, 19:187, 1990.
Rothstein, Targeting, disruption, replacement, and allele rescue: integrative DNA transformation in Yeast, Methods Enzymol. 194, 281-301, 1991.
Sambrook, et al., Molecular Cloning: A Laboratory Manual, 2nd ed., Cold Spring Harbor Laboratory: Cold Spring Harbor, NY (1989).
Sauer, Functional expression of the cre-lox site specific recombination system in the yeast *Saccharomyces cerevisiae*, Mol. Cell. Biol. 7:2087-2096, 1987.
Senecoff, et al., DNA recognition by the FLP recombinase of the yeast 2 u plasmid, J. Mol. Biol. 201:405-421, 1988.
Shin, et al., Exploring the active site of amine: pyruvate aminotransferase on the basis of the substrate structure-reactivity relationship: how the enzyme controls substrate specificity and stereoselectivity, J Org. Chem. 67:2848-2853, 2002.
Sulter et al., Proliferation and metabolic significance of peroxisomes in Candida boidinii during growth on D-alanine or oleic acid as the sole carbon source, Archiv. Microbiol. 153:485-489, 1990.
Tabor, et al., A bacteriophage T7 RNA polymerase/promoter system for controlled exclusive expressive of specific genes, Proc. Natl. Acad. Sci. USA 82:1074-1078, 1985.
Thein, et al., "The use of oligonucleotides as specific hybridization probes in the diagnosis of genetic disorders," in Human Genetic Disease: Practical Approach, K. E. Davis Ed., 1986, pp. 33-50.
Van Ness, et al., The use of oligodeoxynucleotide probes in chaotrope-based hybridization solutions, Nucleic Acids Res. 19:5143-5151, 1991.
Voloch, et al., "Fermentation Derived 2,3-Butanediol," in: Comprehensive Biotechnology, Pergamon Press Ltd., England, vol. 2, Section 3, pp. 933-947, 1986.
Wach, et al., New Heterologous modules for classical or PCR-based gene disruption in Saccharomyces cerevisiae, Yeast 10:1793-1808, 1994.
Walker, et al., Isothermal in vitro amplification of DNA by a restriction enzyme/DNA polymerase system, Proc. Natl. Acad. Sci. USA. 89:392-396, 1992.
Yu et al. Double-joint PCR: a PCR-based molecular tool for gene manipulations in filamentous fungi, Fungal Genet. Biol. 41:973-981, 2004.
International Preliminary Report on Patentability for corresponding International Application No. PCT/US2011/050689, Mar. 12, 2013.
GenBank Accession No. AAA25079, acetolactate synthase [Klebsiella pneumoniae], Mod. date: Aug. 5, 1994; viewed Nov. 17, 2009.
GenBank Accession No. AAA65614.1, keto acid dehydrogenase E1-alpha subunit [Pseudomonas putida], Mod. date: Feb. 27, 2002; viewed Apr. 22, 2010.
GenBank Accession No. AAA65615.1, 39 kDa keto acid dehydrogenase E1-beta subunit [Pseudomonas putida], Mod. date: Feb. 27, 2002; viewed Apr. 22, 2010.
GenBank Accession No. AAA65617.1, transacylase E2 [Pseudomonas putida], Mod. date: Feb. 27, 2002; viewed Apr. 22, 2010.
GenBank Accession No. AAA65618.1, lipoamide dehydrogenase [Pseudomonas putida], Mod. date: Feb. 27, 2002; viewed Apr. 22, 2010.
GenBank Accession No. AAA89106.1, acetaldehyde dehydrogenase (acylating) [Pseudomonas putida], Mod. date: Feb. 26, 1996, viewed May 6, 2010.
GenBank Accession No. AAC08713.1, coenzyme B12-dependent isobutyrylCoA mutase [Streptomyces cinnamonensis], Mod. date: Mar. 31, 1998, viewed May 6, 2010.
GenBank Accession No. AAD31841.1, coenzyme A acylating aldehyde dehydrogenase [Clostridium beijerinckii], Mod. date: May 17, 2004, viewed Mar. 8, 2010.
GenBank Accession No. AAN10242.1, valine decarboxylase [Streptomyces viridifaciens], Mod. date: Jan. 17, 2003, viewed May 6, 2010.
GenBank Accession No. AAN66223.1 beta-alanine—pyruvate transaminase [Pseudomonas putida KT2440], Mod. date: Mar. 5, 2010, viewed May 6, 2010.
GenBank Accession No. AAS49166.1, branched-chain alphaketoacid decarboxylase [Lactococcus lactis], Mod. date: Dec. 27, 2004, viewed Nov. 17, 2009.
GenBank Accession No. AF157306.2, Clostridium beijerinckii strain NRRL B593 hypothetical protein, coenzyme A acylating aldehyde dehydrogenase (ald), acetoacetate:butyrate/acetate coenzyme A transferase (ctfA), acetoacetate: butyrate/acetate coenzyme a transferase (ctfB), and acetoacetate decarb . . . , Mod. date: May 17, 2004, viewed Mar. 9, 2010.
GenBank Accession No. AJ746364.1, Lactococcus lactis subsp. lactis kivd gene for alphaketoisovalerate decarboxylase, strain IFPL730. Mod. date: Apr. 15, 2005, viewed Nov. 17, 2009.
GenBank Accession No. AL009126.3, Bacillus subtilis subsp. subtilis str. 168 complete genome, Mod. date: Oct. 1, 2009, viewed Dec. 1, 2009.
GenBank Accession No. AY548760.1, Lactococcus lactis branched-chain alpha-ketoacid decarboxylase (kdcA) gene, complete cds, Mod. date: Dec. 27, 2004, viewed Nov. 17, 2009.
GenBank Accession No. BX950229.1, Methanococcus maripaludis strain S2, complete sequence, Mod. date: May 8, 2008, viewed Dec. 1, 2009.
GenBank Accession No. CAB14105.2, dihydroxy-acid dehydratase [Bacillus subtilis subsp. subtilis str. 168], Mod. date: Oct. 1, 2009, viewed Nov. 17, 2009.
GenBank Accession No. CAB14334.1, branched-chain alpha-keto acid dehydrogenase E2 subunit (lipoamide acyltransferase) [Bacillus subtilis subsp. subtilis str. 168]. Mod. date: Oct. 1, 2009, viewed Apr. 22, 2010.
GenBank Accession No. CAB14335.1, branched-chain alpha-keto acid dehydrogenase El subunit [Bacillus subtilis subsp. subtilis str. 168], Mod. date: Oct. 1, 2009, viewed Apr. 22, 2010.
GenBank Accession No. CAB14336.1, branched-chain alpha-keto acid dehydrogenase El subunit [Bacillus subtilis subsp. subtilis str. 168], Mod. date: Oct. 1, 2009, viewed Apr. 22, 2010.
GenBank Accession No. CAB14337.2, branched-chain alpha-keto acid dehydrogenase E3 subunit (dihydrolipoamide dehydrogenase) [Bacillus subtilis subsp. subtilis str.168], Mod. date: Oct. 1, 2009, viewed Apr. 22, 2010.
GenBank Accession No. CAB14339.1, branched-chain amino acid dehydrogenase [Bacillus subtilis subsp. subtilis str. 168], Mod. date: Oct. 1, 2009, viewed May 6, 2010.
GenBank Accession No. CAB14789.1, acetohydroxy-acid isomeroreductase [Bacillus subtilis subsp. subtilis str. 168], Mod. date: Oct. 1, 2009, viewed Nov. 17, 2009.
GenBank Accession No. CAB15618.2, alpha-acetolactate synthase [Bacillus subtilis subsp. subtilis str. 168], Mod. date: Oct. 1, 2009, viewed Nov. 17, 2009.
GenBank Accession No. NP_011764.1, 6-phosphogluconolactonase with similarity to Sol3p [Saccharomyces cerevisiae], Mod. date: Dec. 9, 2009, viewed May 6, 2010.

(56) References Cited

OTHER PUBLICATIONS

GenBank Accession No. CAF29874.1, dihydroxy-acid dehydratase [Methanococcus maripaludis S2], Mod. date: May 8, 2008, viewed Nov. 17, 2009.
GenBank Accession No. CAF30210.1, ketol-acid reductoisomerase [Methanococcus maripaludis S2], Mod. date: May 8, 2008, viewed Dec. 1, 2009.
GenBank Accession No. CAG34226.1, alpha-ketoisovalerate decarboxylase [Lactococcus lactis subsp. lactis], Mod. date: Apr. 15, 2005, viewed Nov. 17, 2009.
GenBank Accession No. M57613.1, Pseudomonas putida branched-chain keto acid dehydrogenase operon (bkdA1, bkdA1 and bkdA2), transacylase E2 (bkdB), bkdR and lipoamide dehydrogenase (IpdV) genes, complete cds, Mod. date: Feb. 27, 2002, viewed Apr. 22, 2010.
GenBank Accession No. M73842.1, Klebsiella pneumoniae acetolactate synthase (iluk) gene, complete cds. Mod. date: Aug. 5, 1994, viewed Nov. 17, 2009.
GenBank Accession No. ACOL01000913.1, Nosema ceranae BRL01 Nc000913, whole genome shotgun sequence, Mod. date: Jun. 9, 2009, viewed Nov. 17, 2009.
GenBank Accession No. NC_001136.9, Saccharomyces cerevisiae chromosome IV, complete sequence, Mod. date: Dec. 9, 2009, viewed Mar. 9, 2010.
GenBank Accession No. ACOL01001142.1, Nosema ceranae BRL01 Nc001142, whole genome shotgun sequence, Mod. date: Jun. 9, 2009, viewed Nov. 17, 2009.
GenBank Accession No. NC_001144.4, Saccharomyces cerevisiae chromosome XII, complete sequence, Mod. date: Dec. 9, 2009, viewed Apr. 15, 2010.
GenBank Accession No. NC_001145.2, Saccharomyces cerevisiae chromosome XII, complete sequence, Mod. date: Dec. 9, 2009, viewed Mar. 9, 2010.
GenBank Accession No. NC_001988.2, Clostridium acetobutylicum ATCC 824 plasmid pSOL1, complete sequence, Mod. date: Apr. 26, 2009, viewed Apr. 15, 2010.
GenBank Accession No. NC_003030.1, Clostridium acetobutylicum ATCC 824, complete genome, Mod. date: Oct. 22, 2009, viewed Mar. 9, 2010.
GenBank Accession No. NC_003197.1, Salmonella typhimurium LT2, complete genome, Mod. date: Mar. 30, 2010, viewed Apr. 15, 2010.
GenBank Accession No. NP_012550.1, Dihydroxyacid dehydratase, catalyzes third step in the common pathway leading to biosynthesis of branched-chain amino acids; Ilv3p [Saccharomyces cerevisiae], Mod. date: Nov. 5, 2009, viewed Nov. 17, 2009.
GenBank Accession No. NP_012682.1, Bat2p [Saccharomyces cerevisiae], Mod. date: Dec. 9, 2009, viewed May 11, 2010.
GenBank Accession No. NP_013459.1, Acetohydroxyacid reductoisomerase, mitochondria! protein involved in branchedchain amino acid biosynthesis, also required for maintenance of wildtype mitochondria DNA and found in mitochondrial nucleoids; Ilv5p [Saccharomyces cerevisiae], Mod. date: Jun. 16, 2008, viewed Nov. 17, 2009.
GenBank Accession No. NP_014051.1, Adh6p [Saccharomyces cerevisiae], Mod. date: Dec. 9, 2009, viewed Apr. 15, 2010.
GenBank Accession No. NP_149189.1, pyruvate decarboxylase [Clostridium acetobutylicum ATCC 824], Mod. date: Apr. 26, 2009, viewed Nov. 17, 2009.
GenBank Accession No. NP_149325.1, bifunctional acetaldehyde-CoA/alcohol dehydrogenase [Clostridium acetobutylicum ATCC 824], Mod. date: Apr. 26, 2009, viewed Apr. 15, 2010.
GenBank Accession No. NP_276546.1, branched-chain amino-acid aminotransferase [Methanothermobacter thermautotrophicus str. Delta H], Mod. date: May 5, 2010, viewed May 11, 2010.
GenBank Accession No. NP_349891.1, NADH-dependent butanol dehydrogenase B (BDH II) [Clostridium acetobutylicum ATCC 824], Mod. date: Apr. 14, 2010, viewed Apr. 15, 2010.
GenBank Accession No. NP_349892.1, NADH-dependent butanol dehydrogenase a (BDH I) [Clostridium acetobutylicum ATCC 824], Mod. date: Apr. 14, 2010, viewed Apr. 15, 2010.
GenBank Accession No. NP_417484.1, alcohol dehydrogenase, NAD(P)-dependent [*Escherichia coli* str. K-12 substr. MG1655], Mod.date: Apr. 9, 2010, viewed Apr. 15, 2010.
GenBank Accession No. NP_418222.1, ketol-acid reductoisomerase, NAD(P)-binding [*Escherichia coli* str. K-12 substr. MG1655], Mod. date: Jul. 30, 2009, viewed Nov. 17, 2009.
GenBank Accession No. NP_461346.1, indolepyruvate decarboxylase [Salmonella typhimurium LT2], Mod. date: Apr. 9, 2009, viewed Nov. 17, 2009.
GenBank Accession No. NP_628270.1, valine dehydrogenase [Streptomyces coelicolor A3(2)], Mod. date: Mar. 30, 2010, viewed May 11, 2010.
GenBank Accession No. NP_719046.1, beta alanine—pyruvate transaminase [Shewanella oneidensis MR-1], Mod. date: Mar. 31, 2010, viewed May 11, 2010.
GenBank Accession No. NP_824008.1, isobutyryl-CoA mutase, chain A [Streptomyces avermitilis MA-4680], Mod. date: Mar. 31, 2010, viewed May 11, 2010.
GenBank Accession No. YP_026231.1, valine-pyruvate aminotransferase [*Escherichia coli* str. K-12 substr. MG1655], Mod. date: Apr. 9, 2010, viewed May 11, 2010.
GenBank Accession No. YP_026247.1, branched-chain amino-acid aminotransferase [*Escherichia coli* str. K-12 substr. MG1655], Mod. date: Apr. 9, 2010, viewed May 11, 2010.
GenBank Accession No. YP_026248.1, dihydroxyacid dehydratase [*Escherichia coli* str. K-12 substr. MG1655], Mod. date: Feb. 13, 2011, viewed May 26, 2011.
GenBank Accession No. YP_093743.1, valine—pyruvate transaminase [Bacillus licheniformis ATCC 14580], Mod. date: Apr. 1, 2010, viewed May 12, 2010.
GenBank Accession No. YP_145486.1, acetaldehyde dehydrogenase [Thermus thermophilus HB8], Mod. date: Mar. 12, 2010, viewed May 12, 2010.
GenBank Accession No. YP_294474.1, beta alanine—pyruvate transaminase [Ralstonia eutropha JMP134], Mod. date: Mar. 31, 2010, viewed May 12, 2010.

* cited by examiner

| | |
|---|---|
| 1 | Bacillus cereus E33L |
| 2 | Bacillus thuringiensis serovar konkukian str. 97-27 |
| 3 | Bacillus cereus G9241 |
| 4 | Bacillus cereus B4264 |
| 5 | Bacillus cereus AH1134 |
| 6 | Bacillus cereus ATCC 14579 |
| 7 | Bacillus cereus G9842 |
| 8 | Bacillus thuringiensis serovar israelensis ATCC 35646 |
| 9 | Bacillus cereus 03BB108 |
| 10 | Bacillus cereus NVH0597-99 |
| 11 | Bacillus thuringiensis str. Al Hakam |
| 12 | Bacillus anthracis str. Ames |
| 13 | Bacillus cereus W |
| 14 | Bacillus cereus AH187 |
| 15 | Bacillus cereus ATCC 10987 |
| 16 | Bacillus weihenstephanensis KBAB4 |
| 17 | Listeria monocytogenes F5L J1-208 |
| 18 | Listeria welshimeri serovar 6b str. SLCC5334 |
| 19 | Listeria innocua clip 11262 |
| 20 | Listeria monocytogenes F5L J1-175 |
| 21 | Listeria monocytogenes str. 4b H7858 |
| 22 | Listeria monocytogenes str. 4b F2365 |
| 23 | Listeria monocytogenes HP B2262 |
| 24 | Listeria monocytogenes F5L N1-017 |
| 25 | Listeria monocytogenes str. 1/2a F6854 |
| 26 | Listeria monocytogenes EDG-e |
| 27 | Exiguobacterium sibiricum 255-15 |
| 28 | Bacillus coagulans 36D1 |
| 29 | Bacillus licheniformis ATCC 14580 |
| 30 | Bacillus pumilus 5A FR-032 |
| 31 | Bacillus amyloliquefaciens FZB42 |
| 32 | Unknown |
| 33 | Bacillus subtilis subsp. subtilis str. 168 |
| 34 | Bacillus subtilis |
| 35 | Staphylococcus haemolyticus JC5C1435 |
| 36 | Staphylococcus epidermidis ATCC 12228 |
| 37 | Staphylococcus saprophyticus subsp. saprophyticus ATCC 15305 |
| 38 | Staphylococcus aureus subsp. aureus Mu 50 |
| 39 | Staphylococcus aureus subsp. aureus MRSA252 |
| 40 | Staphylococcus aureus subsp. aureus NCTC 8325 |
| 41 | Staphylococcus aureus |
| 42 | Staphylococcus aureus subsp. aureus MW2 |
| 43 | Staphylococcus aureus RF122 |
| 44 | Lactococcus lactis subsp. lactis il1403 |
| 45 | Lactococcus lactis subsp. cremoris MG 1363 |

FIG. 4B

| | |
|---|---|
| 46 | Lactococcus lactis subsp. cremoris SK11 |
| 47 | Streptococcus infantarius subsp. infantarius ATCC BAA-102 |
| 48 | Streptococcus agalactiae COH1 |
| 49 | Streptococcus agalactiae 2603V/R |
| 50 | Streptococcus agalactiae NEM316 |
| 51 | Streptococcus mutans UA 159 |
| 52 | Streptococcus thermophilus LMD-9 |
| 53 | Streptococcus thermophilus LMG 18311 |
| 54 | Streptococcus thermophilus CNRZ1066 |
| 55 | Streptococcus thermophilus |
| 56 | Enterococcus faecium D0 |
| 57 | Enterococcus faecalis V583 |
| 58 | Lactobacillus brevis ATCC 367 |
| 59 | Oenococcus oeni |
| 60 | Oenococcus oeni P SU-1 |
| 61 | Oenococcus oeni ATCC BAA-1163 |
| 62 | Lactobacillus reuteri F275 |
| 63 | Lactobacillus reuteri |
| 64 | Lactobacillus reuteri 100-23 |
| 65 | Leuconostoc mesenteroides subsp. mesenteroides ATCC 8293 |
| 66 | Leuconostoc lactis |
| 67 | Leuconostoc citreum KM20 |
| 68 | Lactobacillus casei ATCC 334 |
| 69 | Pediococcus pentosaceus ATCC 25745 |
| 70 | Lactobacillus fermentum IFO 3956 |
| 71 | Lactobacillus plantarum WCF51 |
| 72 | Lactobacillus sakei subsp. sakei 23K |
| 73 | Lactobacillus salivarius UCC118 |
| 74 | Lactobacillus johnsonii NCC 533 |
| 75 | Mycobacterium marinum |
| 76 | Mycobacterium ulcerans Agy99 |
| 77 | Magnaporthe grisea 70-15 |
| 78 | Phaeosphaeria nodorum SN15 |
| 79 | Methylococcus capsulatus str. Bath |
| 80 | Vibrio angustum S14 |
| 81 | Synechococcus sp. CC9605 |
| 82 | Vibrio cholerae 1587 |
| 83 | Vibrio cholerae AM-19226 |
| 84 | Vibrio cholerae 623-39 |
| 85 | Vibrio cholerae O 1 biovar eltor str. N1... |
| 86 | Vibrio cholerae V51 |
| 87 | Vibrio cholerae 2740-80 |
| 88 | Vibrio cholerae V52 |
| 89 | Vibrio alginolyticus 12G01 |
| 90 | Vibrio sp. Ex25 |

FIG. 4C

| | |
|---|---|
| 91 | Serratia protoemaculans 568 |
| 92 | Aeromonas hydrophila subsp. hydrophila ATCC 7966 |
| 93 | Enterobacter sp. 638 |
| 94 | Enterobacter sakazakii ATCC BAA-894 |
| 95 | Raoultella terrigena |
| 96 | Klebsiella pneumoniae subsp. pneumoniae MGH 78578 |
| 97 | Klebsiella pneumoniae |
| 98 | Klebsiella pneumoniae |
| 99 | Pectobacterium atrosepticum 5CRII043 |
| 100 | Versinia intermedia ATCC 29909 |
| 101 | Versinia enterocolitica subsp. enterocolitica 8081 |

FIG. 4D pdc1::ilvD::pUC19-kan::FBA-alsS::trx1 locus
11305 bp

US 9,267,157 B2

BUTANOL STRAIN IMPROVEMENT WITH INTEGRATION OF A POLYNUCLEOTIDE ENCODING A POLYPEPTIDE THAT CATALYZES PYRUVATE TO ACETOLACTATE CONVERSION

CROSS-REFERENCE TO RELATED APPLICATIONS

This application is related to and claims the benefit of priority of U.S. Provisional Patent Application No. 61/380,563, filed Sep. 7, 2010 and U.S. Provisional Patent Application No. 61/466,557, filed Mar. 23, 2011, both of which are herein incorporated by reference in their entireties.

REFERENCE TO SEQUENCE LISTING SUBMITTED ELECTRONICALLY

The content of the electronically submitted sequence listing in ASCII text file (Name: 20110907_CL5178USNA_SeqList.txt, Size: 669,953 bytes, and Date of Creation: Aug. 31, 2011) filed with the application is incorporated herein by reference in its entirety.

FIELD OF THE INVENTION

The invention relates to the field of industrial microbiology and the fermentative production of butanol and isomers thereof. More specifically, the invention relates to recombinant host cells having one or more integrated polynucleotide encoding a polypeptide that catalyzes a step in a pyruvate-utilizing biosynthetic pathway, e.g., pyruvate to acetolactate conversion.

BACKGROUND OF THE INVENTION

Butanol is an important industrial chemical, useful as a fuel additive, as a feedstock chemical in the plastics industry, and as a foodgrade extractant in the food and flavor industry. Each year 10 to 12 billion pounds of butanol are produced by petrochemical means and the need for this commodity chemical will likely increase. 2-butanone, also referred to as methyl ethyl ketone (MEK), is a widely used solvent and is the most important commercially produced ketone, after acetone. It is used as a solvent for paints, resins, and adhesives, as well as a selective extractant, activator of oxidative reactions, and can be chemically converted to 2-butanol by reacting with hydrogen in the presence of a catalyst (Nystrom et al., *J. Am. Chem. Soc.,* 69:1198, 1947). 2,3-butanediol can be used in the chemical synthesis of butene and butadiene, important industrial chemicals currently obtained from cracked petroleum, and esters of 2,3-butanediol can be used as plasticizers (Voloch et al., "Fermentation Derived 2,3-Butanediol," in: Comprehensive Biotechnology, Pergamon Press Ltd., England, Vol. 2, Section 3, pp. 933-947, 1986).

Microorganisms can be engineered for expression of biosynthetic pathways for the production of products such as 2,3-butanediol, 2-butanone, 2-butanol and isobutanol. U.S. Pat. No. 7,851,188 discloses the engineering of recombinant microorganisms for production of isobutanol. U.S. Appl. Pub. Nos. 20070259410 and 20070292927 disclose the engineering of recombinant microorganisms for the production of 2-butanone or 2-butanol. Multiple pathways are known for the biosynthesis of isobutanol and 2-butanol, all of which initiate with cellular pyruvate. Butanediol is an intermediate in the 2-butanol pathway disclosed in U.S. Appl. Pub. No. 20070292927.

Pyruvate metabolism has been altered in yeast for the production of lactic acid and glycerol. U.S. Appl. Pub. No. 20070031950 discloses a yeast strain with a disruption of one or more pyruvate decarboxylase or pyruvate dehydrogenase genes and expression of a D-lactate dehydrogenase gene, which is used for the production of D-lactic acid. Ishida et al. (*Biosci. Biotech. and Biochem.,* 70:1148-1153, 2006) describe *Saccharomyces cerevisiae* with disrupted pyruvate decarboxylase genes and expression of lactate dehydrogenase. U.S. Appl. Pub. No. 2005/0059136 discloses glucose tolerant C2 carbon source-independent (GCSI) yeast strains with no pyruvate decarboxylase activity, which can have an exogenous lactate dehydrogenase gene. Nevoigt et al. (*Yeast,* 12:1331-1337, 1996) describe the impact of reduced pyruvate decarboxylase and increased NAD-dependent glycerol-3-phosphate dehydrogenase in *Saccharomyces cerevisiae* on glycerol yield.

Stable production of polynucleotides by a yeast cell for pyruvate biosynthetic pathways are needed for industrial fermentative production of alcohols or other compounds. Further, there is a need for improved means of isobutanol, 2,3-butanediol, 2-butanol or 2-butanone production in recombinant host cells such as yeast.

BRIEF SUMMARY OF THE INVENTION

Provided herein are recombinant host cells having one or more integrated polynucleotides encoding a polypeptide that catalyzes a step in a pyruvate-utilizing biosynthetic pathway, e.g., pyruvate to acetolactate conversion. Such host cells provide a means to stabilize and/or increase product formation of a biosynthetic pathway, such as isobutanol, 2,3-butanediol, 2-butanol or 2-butanone, compared to host cells which do not have an integrated polynucleotide encoding a polypeptide that catalyzes biosynthetic pathway steps such as pyruvate to acetolactate conversion.

One aspect of the invention relates to a recombinant host cell comprising a polynucleotide encoding a polypeptide which catalyzes the conversion of pyruvate to acetolactate integrated into the chromosome of the host cell. In another aspect, the host cell comprises a pyruvate-utilizing biosynthetic pathway and a polynucleotide encoding a polypeptide which catalyzes the conversion of pyruvate to acetolactate integrated into the chromosome of the host cell. In another aspect, the polynucleotide is heterologous to the host cell.

An aspect of the invention relates to a recombinant host cell comprising an isobutanol biosynthetic pathway wherein said pathway comprises the substrate to product conversion pyruvate to acetolactate catalyzed by a polypeptide encoded by a heterologous polynucleotide integrated into the chromosome and wherein said pathway comprises the substrate to product conversion acetolactate to 2,3-dihydroxyisovalerate catalyzed by a polypeptide encoded by a polynucleotide on a plasmid. In embodiments, the titer of isobutanol production is increased as compared to a recombinant host cell wherein the polynucleotide encoding a polypeptide that catalyzes the conversion of pyruvate to acetolactate is not integrated into the chromosome.

An aspect of the invention relates to a recombinant host cell comprising a 2,3-butanediol, 2-butanol, or 2-butanone biosynthetic pathway wherein said pathway comprises the substrate to product conversion pyruvate to acetolactate catalyzed by a polypeptide encoded by a heterologous polynucleotide integrated into the chromosome and wherein said pathway comprises at least one substrate to product conversion catalyzed by a polypeptide encoded by a polynucleotide on a plasmid. In embodiments, the titer of 2,3- butanediol, 2-butanol, or 2-butanone production is increased as compared to a recombinant host cell wherein the polynucleotide encoding a polypeptide that catalyzes the conversion of pyruvate to acetolactate is not integrated into the chromosome.

In another aspect, the invention relates to a recombinant host cell comprising a first heterologous polynucleotide encoding a first polypeptide which catalyzes the conversion of a step of a pyruvate-utilizing biosynthetic pathway; a second heterologous polynucleotide encoding a second polypeptide which catalyzes the conversion of a step of a pyruvate-utilizing biosynthetic pathway; and a third heterologous polynucleotide encoding a third polypeptide which catalyzes the conversion of a step of a pyruvate-utilizing biosynthetic pathway; wherein the first and second heterologous polynucleotides are integrated into the chromosome of the host cell; wherein the third heterologous polynucleotide is not integrated into the chromosome of the host cell; and wherein the first, second, and third polypeptides catalyze different steps of the pyruvate-utilizing biosynthetic pathway.

In another aspect, the invention relates to a recombinant host cell comprising (a) a first heterologous polynucleotide encoding a first polypeptide which catalyzes a substrate to product conversion of pyruvate to acetolactate; (b) a second heterologous polynucleotide encoding a second polypeptide which catalyzes the substrate to product conversion of α-ketoisovalerate to isobutyraldehyde; and (c) a third heterologous polynucleotide encoding a third polypeptide which catalyzes the conversion of a step of a isobutanol biosynthetic pathway that is not the conversion of (a) or (b); wherein the first and second heterologous polynucleotides are integrated into the chromosome; wherein the third heterologous polynucleotide is not integrated into the chromosome; and wherein the host cell produces isobutanol.

In another aspect, the invention relates to a recombinant host cell comprising (a) a first heterologous polynucleotide encoding a first polypeptide which catalyzes a substrate to product conversion of α-ketoisovalerate to isobutyraldehyde; and (b) a second heterologous polynucleotide encoding a second polypeptide which catalyzes the conversion of a step of a isobutanol biosynthetic pathway that is not the conversion of (a); wherein the first heterologous polynucleotide is integrated into the chromosome; wherein the second heterologous polynucleotide is not integrated into the chromosome; and wherein the host cell produces isobutanol.

In aspects of the invention, the host cell is a bacterium, a cyanobacterium, a filamentous fungus, or a yeast. In another aspect, the host cell is a member of the genus *Clostridium, Zymomonas, Escherichia, Salmonella, Rhodococcus, Pseudomonas, Bacillus, Lactobacillus, Enterococcus, Alcaligenes, Klebsiella, Issatchenkia, Paenibacillus, Arthrobacter, Corynebacterium, Brevibacterium, Pichia, Candida, Hansenula,* or *Saccharomyces*. In another aspect, the host cell is *Escherichia coli, Alcaligenes eutrophus, Bacillus licheniformis, Paenibacillus macerans, Rhodococcus erythropolis, Pseudomonas putida, Bacillus subtilis, Lactobacillus plantarum, Enterococcus faecium, Enterococcus gallinarium, Enterococcus faecalis* or *Saccharomyces cerevisiae*. In another aspect, the host cell is a facultative anaerobe.

In another aspect of the invention, the pyruvate-utilizing biosynthetic pathway comprises one or more polynucleotides encoding polypeptides that catalyze a substrate to product conversion of the pathway. In another aspect, one or more of the polynucleotides are integrated into the chromosome. In another aspect, the pyruvate-utilizing biosynthetic pathway forms the product 2,3-butanediol, isobutanol, 2-butanol or 2-butanone.

In one aspect of the invention, the pyruvate-utilizing biosynthetic pathway is a butanol biosynthetic pathway. In another aspect, the butanol biosynthetic pathway is a 2-butanol biosynthetic pathway or an isobutanol biosynthetic pathway. In another aspect, the host cell comprises one or more polynucleotides encoding a polypeptide that catalyzes a substrate to product conversion of (i) pyruvate to acetolactate; (ii) acetolactate to 2,3-dihydroxyisovalerate; (iii) 2,3-dihydroxyisovalerate to α-ketoisovalerate; (iv) α-ketoisovalerate to isobutyraldehyde; or (v) isobutyraldehyde to isobutanol. In another aspect, one or more of the polynucleotides of (ii), (iii), (iv), or (v) are on a plasmid. In another aspect, the host cell comprises one or more polynucleotides encoding a polypeptide that catalyzes a substrate to product conversion of (i) pyruvate to acetolactate; (ii) acetolactate to 2,3-dihydroxyisovalerate; (iii) 2,3-dihydroxyisovalerate to α-ketoisovalerate; (iv) α-ketoisovalerate to isobutyryl-CoA; (v) isobutyryl-CoA to isobutyraldehyde; or (vi) isobutyraldehyde to isobutanol. In another aspect, one or more of the polynucleotides of (ii), (iii), (iv), (v), or (vi) are on a plasmid. In another aspect, the host cell comprises one or more polynucleotides encoding a polypeptide that catalyzes a substrate to product of (i) pyruvate to acetolactate; (ii) acetolactate to 2,3-dihydroxyisovalerate; (iii) 2,3-dihydroxyisovalerate to α-ketoisovalerate; (iv) α-ketoisovalerate to valine; (v) valine to isobutylamine; (vi) isobutylamine to isobutyraldehyde; or (vii) isobutyraldehyde to isobutanol. In another aspect, one or more of the polynucleotides of (ii), (iii), (iv), (v), (vi), or (vii) are on a plasmid.

In another aspect of the invention, the host cell comprises one or more polynucleotides encoding a polypeptide that catalyzes a substrate to product conversion of (i) pyruvate to acetolactate; (ii) acetolactate to acetoin; (iii) acetoin to 2,3-butanediol; or (iv) 2,3-butanediol to 2-butanone. In another aspect, one or more of the polynucleotides of (ii), (iii), or (iv) are on a plasmid. In another aspect, the host cell comprises one or more polynucleotides encoding a polypeptide that catalyzes a substrate to product conversion of (i) pyruvate to acetolactate; (ii) acetolactate to acetoin; (iii) acetoin to 2,3-butanediol; (iv) 2,3-butanediol to 2-butanone; or (v) 2-butanone to 2-butanol. In another aspect, one or more of the polynucleotides of (ii), (iii), (iv), or (v) are on a plasmid.

In another aspect of the invention, the host cell comprises one or more polynucleotides encoding a polypeptide that catalyzes a substrate to product conversion of (i) pyruvate to acetolactate; (ii) alpha-acetolactate to acetoin; (iii) acetoin to 3-amino-2-butanol; (iv) 3-amino-2-butanol to 3-amino-2-butanol phosphate; (v) or 3-amino-2-butanol phosphate to 2-butanone. In another aspect, one or more of the polynucleotides of (ii), (iii), (iv), or (v) are on a plasmid. In another aspect, the host cell comprises one or more polynucleotides encoding a polypeptide that catalyzes a substrate to product conversion of (i) pyruvate to acetolactate; (ii) alpha-acetolactate to acetoin; (iii) acetoin to 3-amino-2-butanol; (iv) 3-amino-2-butanol to 3-amino-2-butanol phosphate; (v) 3-amino-2-butanol phosphate to 2-butanone; or (vi) 2-butanone to 2-butanol. In another aspect, one or more of the polynucleotides of (ii), (iii), (iv), (v), or (vi) are on a plasmid.

In another aspect, at least one of the polynucleotides encoding a polypeptide that catalyzes a substrate to product conversion is heterologous. In another embodiment, more than one of the polynucleotides encoding a polypeptide that catalyzes a substrate to product conversion are heterologous. In another embodiment, all of the polynucleotides encoding polypeptides for each of the substrate to product conversions of a pyruvate utilizing biosynthetic pathway are heterologous.

In one aspect of the invention, the polypeptide which catalyzes a substrate to product conversion of pyruvate to acetolactate is acetolactate synthase. In another aspect, the acetolactate synthase has at least about 80% identity to an amino acid sequence of an acetolactate synthase described in Table 1. In another aspect, the acetolactate synthase has at least about 80% identity to an amino acid sequence with SEQ ID NO: 2, 4, 6, 8, 10, 12, 14, 16, or 18. In another aspect, the polypeptide which catalyzes the conversion of pyruvate to acetolactate corresponds to the Enzyme Commission Number EC 2.2.1.6.

In another aspect of the invention, the polypeptide which catalyzes the conversion of acetolactate to 2,3-dihydroxyisovalerate corresponds to the Enzyme Commission Number EC 1.1.1.86. In another aspect, the polypeptide which catalyzes the conversion of 2,3-dihydroxyisovalerate to α-ketoisovalerate corresponds to the Enzyme Commission Number EC 4.2.1.9. In another aspect, the polypeptide which catalyzes the conversion of α-ketoisovalerate to isobutyraldehyde corresponds to the Enzyme Commission Number EC 4.1.1.72 or 4.1.1.1. In another aspect, the polypeptide which catalyzes the conversion of isobutyraldehyde to isobutanol corresponds to the Enzyme Commission Number EC 1.1.1.265, 1.1.1.1 or 1.1.1.2.

In one aspect, the expression of pyruvate decarboxylase in a host cell of the invention is decreased or substantially eliminated. In another aspect, the host cell comprises a deletion, mutation and/or substitution in an endogenous polynucleotide encoding a polypeptide having pyruvate decarboxylase activity.

In another aspect of the invention, one or more of the polynucleotides encoding a polypeptide which catalyzes a step of biosynthetic pathway described herein are in a plasmid. In another aspect, the plasmid comprises a sequence at least about 75%, 80%, 85%, 90%, 95%, 96%, 97%, 98% or 99% identical to one or more of SEQ ID NOs: 1 to 89, or is at least about 75%, 80%, 85%, 90%, 95%, 96%, 97%, 98% or 99% identical to any one of SEQ ID NOs: 129-133 or a coding region thereof.

In one aspect, the expression of glycerol-3-phosphate dehydrogenase in a host cell of the invention is decreased or substantially eliminated. In another aspect, the expression of FRA2 in a host cell of the invention is decreased or substantially eliminated. In another aspect, one or more of the polynucleotides described herein is integrated into the chromosome of the host cell at the PDC1-TRX1 intergenic region.

In one aspect, the invention relates to a method of producing a product of a biosynthetic pathway from a host cell of the invention. In another aspect, the invention relates to a method of producing butanol, comprising (a) providing a recombinant host cell of the invention; and (b) contacting the host cell with a fermentable carbon substrate to form a fermentation broth under conditions whereby butanol is produced. In another aspect, the method further comprises contacting the fermentation broth with an extractant to produce a two-phase fermentation mixture. In another aspect, the extractant comprises fatty acids. In another aspect, the fatty acids are derived from corn oil or soybean oil. In another aspect, the extractant comprises a water immiscible organic extractant such as $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty amides, or $C_{12}$ to $C_{22}$ fatty aldehydes. In another aspect, the method further comprises contacting the fermentation broth with an organic acid and an enzyme capable of esterifying the butanol with the organic acid. In another aspect, the method further comprises vaporizing at least a portion of the fermentation broth to form a vapor stream comprising water and butanol.

In one aspect, the rate of butanol production from a host cell of the invention is increased by at least about 10%, at least about 20%, at least about 30%, at least about 40%, at least about 50%, at least about 60%, at least about 70%, at least about 80%, at least about 90%, at least about 95%, at least about 2-fold, at least about 3-fold, or at least about 4-fold greater as compared to a host cell that does not have a polynucleotide encoding a polypeptide that catalyzes the conversion of pyruvate to acetolactate integrated into the chromosome. In another aspect, the titer of butanol production from a host cell of the invention is increased by at least about 10%, at least about 20%, at least about 30%, at least about 40%, at least about 50%, at least about 60%, at least about 70%, at least about 80%, at least about 90%, at least about 95%, at least about 2-fold, at least about 3-fold, or at least about 4-fold greater as compared to a host cell that does not have a polynucleotide encoding a polypeptide that catalyzes the conversion of pyruvate to acetolactate integrated into the chromosome.

In another aspect, the invention relates to a method for increasing the copy number or expression of a non-integrated recombinant polynucleotide encoding a polypeptide that catalyzes a step of a biosynthetic pathway described herein, comprising contacting a host cell of the invention with a fermentable carbon substrate to form a fermentation broth under conditions whereby the product of the biosynthetic pathway is produced. In another aspect, the invention relates to a method for increasing the flux in a pyruvate-utilizing biosynthetic pathway comprising: (a) providing a recombinant host cell of the invention; and (b) contacting the host cell with a fermentable carbon substrate to form a fermentation broth under conditions whereby the flux in the pyruvate-utilizing biosynthetic pathway in the host cell is increased.

In another aspect, the invention relates to a method of producing a recombinant host cell comprising transforming the host cell with (i) one or more polynucleotides encoding a polypeptide that catalyzes a substrate to product conversion of a pyruvate-utilizing biosynthetic pathway; and (ii) a polynucleotide encoding a peptide that catalyzes the conversion of pyruvate to acetolactate; wherein the polynucleotide of (ii) is integrated into the chromosome. In another aspect, the invention relates to a method of increasing the formation of a product of a pyruvate-utilizing biosynthetic pathway comprising (i) providing a recombinant host cell of the invention; and (ii) growing the host cell under conditions wherein the product of the pyruvate-utilizing pathway is formed at an amount of product greater than the amount of product formed by a host cell comprising a polynucleotide encoding a polypeptide which catalyzes the conversion of pyruvate to acetolactate that is not integrated into the chromosome.

In another aspect, the invention relates to a composition comprising (i) a host cell of the invention; (ii) butanol; and (iii) an extractant. In another aspect, the invention relates to a composition comprising (i) a host cell of the invention; (ii) butanol; (iii) an extractant; and (iv) an esterification enzyme. In another aspect, the butanol of such composition is isobutanol.

In another aspect, the invention relates to a method for chromosomally integrating acetolactate synthase (als) into a yeast host cell comprising transforming said host cell with an integration vector comprising SEQ ID NO: 131. In another aspect, the host cell further comprises an isobutanol biosynthetic pathway. In another aspect, the host comprises at least two chromosomally integrated polynucleotides.

BRIEF DESCRIPTION OF THE DRAWINGS/FIGURES

The accompanying drawings, which are incorporated herein and form a part of the specification, illustrate the present invention and, together with the description, further serve to explain the principles of the invention and to enable a person skilled in the pertinent art to make and use the invention.

FIGS. 4A-4D show sequence relationships of acetolactate synthase (als) coding regions that were retrieved by BLAST analysis using the sequence of *B. subtilis* AlsS, limiting to the 100 closest neighbors. The als encoding sequence is identified by its source organism.

Figure 1:
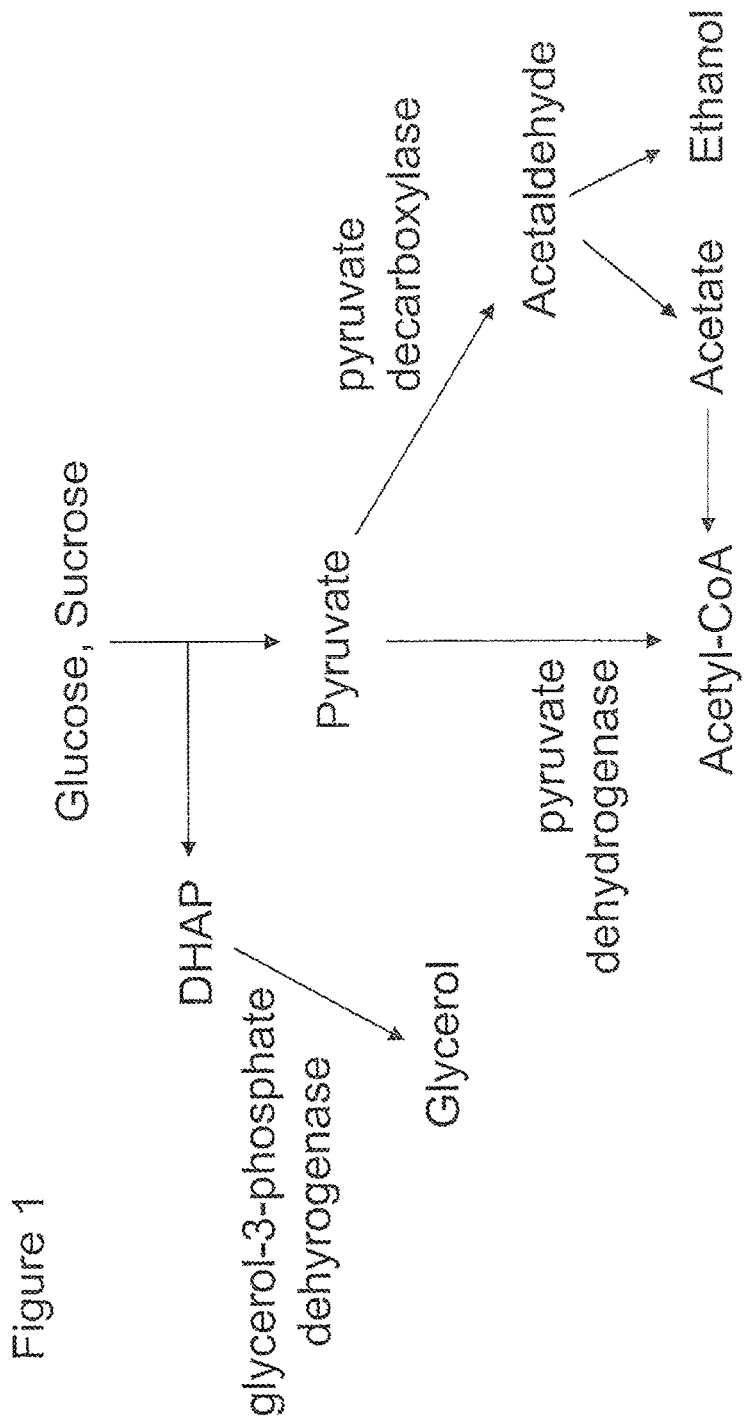
FIG. 1 shows pathways and enzymes for pyruvate utilization.

The invention can be more fully understood from the following detailed description and the accompanying sequence descriptions which form a part of this application.

The following sequences conform with 37 C.F.R. §§1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (2009) and the sequence listing requirements of the EPO and PCT [Rules 5.2 and 49.5 (a-bis), and Section 208 and Annex C of the Administrative Instructions]. The symbols and format used for nucleotide and amino acid sequence data comply with the rules set forth in 37 C.F.R. §1.822.

TABLE 1

SEQ ID Numbers of Coding Regions and Proteins Referred to Herein

| Description | SEQ ID NO: Nucleic acid | SEQ ID NO: Amino acid |
| --- | --- | --- |
| *Klebsiella pneumoniae* budB (acetolactate synthase) | 1 | 2 |
| *Bacillus subtilis* alsS (acetolactate synthase) | 3 | 4 |
| *Lactococcus lactis* als (acetolactate synthase) | 5 | 6 |
| Als *Staphylococcus aureus* | 7 | 8 |
| Als *Listeria monocytogenes* | 9 | 10 |
| Als *Streptococcus mutans* | 11 | 12 |
| Als *Streptococcus thermophiles* | 13 | 14 |
| Als *Vibrio angustum* | 15 | 16 |
| Als *Bacillus cereus* | 17 | 18 |
| budA, acetolactate decarboxylase from *Klebsiella pneumoniae* ATCC 25955 | 19 | 20 |
| alsD, acetolactate decarboxylase from *Bacillus subtilis* | 21 | 22 |
| budA, acetolactate decarboxylase from *Klebsiella terrigena* | 23 | 24 |
| budC, butanediol dehydrogenase from *Klebsiella pneumoniae* IAM1063 | 25 | 26 |
| butanediol dehydrogenase from *Bacillus cereus* | 27 | 28 |
| butB, butanediol dehydrogenase from *Lactococcus lactis* | 29 | 30 |
| RdhtA, B12-indep diol dehydratase from *Roseburia inulinivorans* | 31 | 32 |
| RdhtB, B12-indep diol dehydratase reactivase from *Roseburia inulinivorans* | 33 | 34 |
| sadB, butanol dehydrogenase from *Achromobacter xylosoxidans* | 35 | 36 |
| *S. cerevisiae* ILV5 (acetohydroxy acid reductoisomerase) | 37 | 38 |

TABLE 1-continued

SEQ ID Numbers of Coding Regions and Proteins Referred to Herein

| Description | SEQ ID NO: Nucleic acid | SEQ ID NO: Amino acid |
| --- | --- | --- |
| *Vibrio cholerae* ketol-acid reductoisomerase | 39 | 40 |
| *Pseudomonas aeruginosa* ketol-acid reductoisomerase | 41 | 42 |
| *Pseudomonas fluorescens* ketol-acid reductoisomerase | 43 | 44 |
| *S. cerevisiae* ILV3 (Dihydroxyacid dehydratase; DHAD) | 45 | 46 |
| *Lactococcus lactis* kivD (branched-chain α-keto acid decarboxylase), codon optimized | 47 | 48 |
| *Lactococcus lactis* kivD (branched-chain α-keto acid decarboxylase) | 49 | 48* |
| Pf5.IlvC-Z4B8 mutant *Pseudomonas fluorescens* acetohydroxy acid reductoisomerase | 82 | 83 |
| *Bacillis subtilis* kivD codon optimized for *S. cerevisiae* expression | 84 | 85 |
| *Equus caballus* alcohol dehydrogenase codon optimized for *S. cerevisiae* expression | 86 | 87 |
| *Streptococcus mutans* ilvD (DHAD) | 88 | 89 |
| K9G9 variant of *Anaerostipes caccae* KARI | — | 225 |
| K9D3 variant of *Anaerostipes caccae* KARI | — | 224 |
| *Beijerinkia indica* ADH | — | 237 |
| Ketoisovalerate decarboxylase from *Listeria grayi* | — | 247 |
| Ketoisovalerate decarboxylase from *Macrococcus caseolyticus* | — | 248 |

*The same amino acid sequence is encoded by SEQ ID NOs: 47 and 49.

TABLE 2

SEQ ID Numbers of Target Gene Coding Regions and Proteins Referred to Herein

| Description | SEQ ID NO: Nucleic acid | SEQ ID NO: Amino acid |
| --- | --- | --- |
| PDC1 pyruvate decarboxylase from *Saccharomyces cerevisiae* | 50 | 51 |
| PDC5 pyruvate decarboxylase from *Saccharomyces cerevisiae* | 52 | 53 |
| PDC6 pyruvate decarboxylase from *Saccharomyces cerevisiae* | 54 | 55 |
| pyruvate decarboxylase from *Candida glabrata* | 56 | 57 |
| PDC1 pyruvate decarboxylase from *Pichia stipites* | 58 | 59 |
| PDC2 pyruvate decarboxylase from *Pichia stipites* | 60 | 61 |
| pyruvate decarboxylase from *Kluyveromyces lactis* | 62 | 63 |
| pyruvate decarboxylase from *Yarrowia lipolytica* | 64 | 65 |
| pyruvate decarboxylase from *Schizosaccharomyces pombe* | 66 | 67 |
| GPD1 NAD-dependent glycerol-3-phosphate dehydrogenase from *Saccharomyces cerevisiae* | 68 | 69 |
| GPD2 NAD-dependent glycerol-3-phosphate dehydrogenase from *Saccharomyces cerevisiae* | 70 | 71 |
| GPD1 NAD-dependent glycerol-3-phosphate dehydrogenase from *Pichia stipitis* | 72 | 73 |
| GPD2 NAD-dependent glycerol-3-phosphate dehydrogenase from *Pichia stipites* | 74 | 75 |
| NAD-dependent glycerol-3-phosphate dehydrogenase from *Kluyveromyces thermotolerans* | 76 | 77 |
| GPD1 NAD-dependent glycerol-3-phosphate dehydrogenase from *Schizosaccharomyces pombe* | 78 | 79 |
| GPD2 NAD-dependent glycerol-3-phosphate dehydrogenase from *Schizosaccharomyces pombe* | 80 | 81 |
| AFT1 from *Saccharomyces cerevisiae* | 227 | 228 |

TABLE 2-continued

SEQ ID Numbers of Target Gene Coding Regions and Proteins Referred to Herein

| Description | SEQ ID NO: Nucleic acid | SEQ ID NO: Amino acid |
|---|---|---|
| AFT2 from *Saccharomyces cerevisiae* | 229 | 230 |
| FRA2 from *Saccharomyces cerevisiae* | 231 | 232 |
| GRX3 from *Saccharomyces cerevisiae* | 233 | 234 |
| CCC1 from *Saccharomyces cerevisiae* | 235 | 236 |
| ALD6 from *Saccharomyces cerevisiae* | — | 223 |
| YMR226C from *Saccharomyces cerevisiae* | — | 226 |

SEQ ID NOs:90-222 and 243-246 are sequences used and described in the Examples.

SEQ ID NOs: 238-242 are hybrid promoter sequences referred to herein.

DETAILED DESCRIPTION OF THE INVENTION

Unless defined otherwise, all technical and scientific terms used herein have the same meaning as commonly understood by one of ordinary skill in the art to which this invention belongs. In case of conflict, the present application including the definitions will control. Unless otherwise required by context, singular terms shall include pluralities and plural terms shall include the singular. All publications, patents and other references mentioned herein are incorporated by reference in their entireties for all purposes as if each individual publication or patent application were specifically and individually indicated to be incorporated by reference, unless only specific sections of patents or patent publications are indicated to be incorporated by reference.

The materials, methods and examples are illustrative only and are not intended to be limiting. Other features and advantages of the invention will be apparent from the detailed description and from the claims.

The present invention relates to recombinant microorganisms and methods for the production of butanol. The present invention meets a number of commercial and industrial needs. Butanol is an important industrial commodity chemical with a variety of applications, where its potential as a fuel or fuel additive is particularly significant. Although only a four-carbon alcohol, butanol has energy content similar to that of gasoline and can be blended with any fossil fuel. Butanol is favored as a fuel or fuel additive as it yields only $CO_2$ and little or no $SO_X$ or $NO_X$ when burned in the standard internal combustion engine. Additionally butanol is less corrosive than ethanol, another fuel additive.

In addition to its utility as a biofuel or fuel additive, butanol has the potential of impacting hydrogen distribution problems in the emerging fuel cell industry. Fuel cells today are plagued by safety concerns associated with hydrogen transport and distribution. Butanol can be easily reformed for its hydrogen content and can be distributed through existing gas stations in the purity required for either fuel cells or vehicles.

The following definitions and abbreviations are to be used for the interpretation of the claims and the specification.

As used herein, the terms "comprises," "comprising," "includes," "including," "has," "having," "contains," or "containing," or any other variation thereof, are intended to be non-exclusive or open-ended. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consisting essentially of" in the context of a claim is intended to represent the intermediate ground between a closed claim written in a "consisting of" format and a fully open claim written in a "comprising" format. See M.P.E.P. §2111.03.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about," the claims include equivalents to the quantities. In one embodiment, the term "about" means within 10% of the reported numerical value, preferably within 5% of the reported numerical value.

The term "invention" or "present invention" as used herein is a non-limiting term and is not intended to refer to any single embodiment of the particular invention but encompasses all possible embodiments as described in the specification and the claims.

The term "butanol" as used herein, refers to 2-butanol, isobutanol or mixtures thereof.

The term "isobutanol biosynthetic pathway" refers to an enzyme pathway to produce isobutanol from pyruvate.

The term "2-butanol biosynthetic pathway" refers to an enzyme pathway to produce 2-butanol from pyruvate.

The term "2-butanone biosynthetic pathway" refers to an enzyme pathway to produce 2-butanone from pyruvate.

The term "extractant" as used herein refers to one or more organic solvents which are used to extract butanol and/or other components from a fermentation broth.

The terms "acetolactate synthase" and "acetolactate synthetase" are used interchangeably herein to refer to an enzyme that catalyzes the conversion of pyruvate to acetolactate and $CO_2$. Examples of acetolactate synthases are known by the EC number 2.2.1.6 (*Enzyme Nomenclature* 1992, Academic Press, San Diego). These enzymes are available from a number of sources, including, but not limited to, *Bacillus subtilis* [GenBank Nos: CAB15618 and Z99122, NCBI (National Center for Biotechnology Information) amino acid sequence, NCBI nucleotide sequence, respectively], *Klebsiella pneumoniae* (GenBank Nos: AAA25079 and M73842), and *Lactococcus lactis* (GenBank Nos: AAA25161 and L16975). Additional examples are also provided in Table 1.

The term "acetolactate decarboxylase" refers to a polypeptide (or polypeptides) having an enzyme activity that catalyzes the conversion of alpha-acetolactate to acetoin. Examples of acetolactate decarboxylases are known as EC 4.1.1.5 and are available, for example, from *Bacillus subtilis*

(DNA: SEQ ID NO:21, Protein: SEQ ID NO:22), *Klebsiella terrigena* (DNA: SEQ ID NO:23, Protein: SEQ ID NO:24) and *Klebsiella pneumoniae* (DNA: SEQ ID NO:19, protein: SEQ ID NO:20).

The term "acetoin aminase" refers to a polypeptide (or polypeptides) having an enzyme activity that catalyzes the conversion of acetoin to 3-amino-2-butanol. Acetoin aminase may utilize the cofactor pyridoxal 5'-phosphate or NADH (reduced nicotinamide adenine dinucleotide) or NADPH (reduced nicotinamide adenine dinucleotide phosphate). The resulting product may have (R) or (S) stereochemistry at the 3-position. The pyridoxal phosphate-dependent enzyme may use an amino acid such as alanine or glutamate as the amino donor. The NADH- and NADPH-dependent enzymes may use ammonia as a second substrate. A suitable example of an NADH-dependent acetoin aminase, also known as amino alcohol dehydrogenase, is described by Ito et al. (U.S. Pat. No. 6,432,688). An example of a pyridoxal-dependent acetoin aminase is the amine:pyruvate aminotransferase (also called amine:pyruvate transaminase) described by Shin and Kim (J. Org. Chem. 67:2848-2853 (2002)).

The term "aminobutanol kinase" refers to a polypeptide (or polypeptides) having an enzyme activity that catalyzes the conversion of 3-amino-2-butanol to 3-amino-2-butanol O-phosphate. Aminobutanol kinase may utilize ATP as the phosphate donor. There are reports of enzymes that catalyze the analogous reaction on the similar substrates ethanolamine and 1-amino-2-propanol (Jones et al. (1973) *Biochem. J.* 134: 167-182). U.S. Appl. Pub. No. 20070292927 describes, in Example 14, an amino alcohol kinase of *Erwinia carotovora* subsp. *atroseptica*.

The term "aminobutanol phosphate phospho-lyase", also called "amino alcohol O-phosphate lyase", refers to a polypeptide (or polypeptides) having an enzyme activity that catalyzes the conversion of 3-amino-2-butanol O-phosphate to 2-butanone. Aminobutanol phosphate phospho-lyase may utilize the cofactor pyridoxal 5'-phosphate. There are reports of enzymes that catalyze the analogous reaction on the similar substrate 1-amino-2-propanol phosphate (Jones et al. (1973) *Biochem J.* 134:167-182). U.S. Appl. Pub. No. 20070292927 describes, in Example 15, a newly identified aminobutanol phosphate phospho-lyase from the organism *Erwinia carotovora*.

The term "butanediol dehydrogenase" also known as "acetoin reductase" refers to a polypeptide (or polypeptides) having an enzyme activity that catalyzes the conversion of acetoin to 2,3-butanediol. Butanediol dehydrogenases are a subset of the broad family of alcohol dehydrogenases. Butanediol dehydrogenase enzymes can have specificity for production of (R)- or (S)-stereochemistry in the alcohol product. Examples of (S)-specific butanediol dehydrogenases are known as EC 1.1.1.76 and are available, for example, from *Klebsiella pneumoniae* (DNA: SEQ ID NO:25, protein: SEQ ID NO:26). Examples of (R)-specific butanediol dehydrogenases are known as EC 1.1.1.4 and are available, for example, from *Bacillus cereus* (DNA: SEQ ID NO:27, protein: SEQ ID NO:28), and *Lactococcus lactis* (DNA: SEQ ID NO:29, protein: SEQ ID NO:30).

The terms "acetohydroxy acid isomeroreductase" and "acetohydroxy acid reductoisomerase" and "ketol-acid reductoisomerase" (KARI) are used interchangeably herein to refer to an enzyme that catalyzes the conversion of acetolactate to 2,3-dihydroxyisovalerate. Suitable enzymes utilize NADH (reduced nicotinamide adenine dinucleotide) and/or NADPH as electron donor. Examples of acetohydroxy acid isomeroreductases are known by the EC number 1.1.1.86 and sequences are available from a vast array of microorganisms, including, but not limited to, *Escherichia coli* (GenBank Nos: NP_418222 and NC_000913), *Saccharomyces cerevisiae* (GenBank Nos: NP_013459 and NC_001144), *Methanococcus maripaludis* (GenBank Nos: CAF30210 and BX957220), and *Bacillus subtilis* (GenBank Nos: CAB14789 and Z99118).

The term "acetohydroxy acid dehydratase" refers to an enzyme that catalyzes the conversion of 2,3-dihydroxyisovalerate to α-ketoisovalerate. Examples of acetohydroxy acid dehydratases are known by the EC number 4.2.1.9. These enzymes are available from a vast array of microorganisms, including, but not limited to, *E. coli* (GenBank Nos: YP_026248 and NC_000913), *S. cerevisiae* (GenBank Nos: NP_012550 and NC_001142), *M. maripaludis* (GenBank Nos: CAF29874 and BX957219), and *B. subtilis* (GenBank Nos: CAB14105 and Z99115).

The term "branched-chain α-keto acid decarboxylase" refers to an enzyme that catalyzes the conversion of α-ketoisovalerate to isobutyraldehyde and $CO_2$. Examples of branched-chain α-keto acid decarboxylases are known by the EC number 4.1.1.72 and are available from a number of sources, including, but not limited to, *Lactococcus lactis* (GenBank Nos: AAS49166, AY548760, CAG34226, and AJ746364), *Salmonella typhimurium* (GenBank Nos: NP_461346 and NC_003197), and *Clostridium acetobutylicum* (GenBank Nos: NP_149189 and NC_001988).

The term "branched-chain alcohol dehydrogenase" refers to an enzyme that catalyzes the conversion of isobutyraldehyde to isobutanol. Examples of branched-chain alcohol dehydrogenases are known by the EC number 1.1.1.265, but may also be classified under other alcohol dehydrogenases (specifically, EC 1.1.1.1 or 1.1.1.2). These enzymes utilize NADH (reduced nicotinamide adenine dinucleotide) and/or NADPH as electron donor and are available from a number of sources, including, but not limited to, *S. cerevisiae* (GenBank Nos: NP_010656, NC_001136; NP_014051; and NC_001145), *E. coli* (GenBank Nos: NP_417484 and NC_000913) and *C. acetobutylicum* (GenBank Nos: NP_349892, NC_003030; NP_349891, and NC_003030).

The term "branched-chain keto acid dehydrogenase" refers to an enzyme that catalyzes the conversion of α-ketoisovalerate to isobutyryl-CoA (isobutyryl-coenzyme A), using $NAD^+$ (nicotinamide adenine dinucleotide) as electron acceptor. Examples of branched-chain keto acid dehydrogenases are known by the EC number 1.2.4.4. These branched-chain keto acid dehydrogenases are comprised of four subunits and sequences from all subunits are available from a vast array of microorganisms, including, but not limited to, *B. subtilis* (GenBank Nos: CAB14336, Z99116, CAB14335, Z99116, CAB14334, Z99116, CAB14337, and Z99116) and *Pseudomonas putida* (GenBank Nos: AAA65614, M57613, AAA65615, M57613, AAA65617, M57613, AAA65618, and M57613).

The term "acylating aldehyde dehydrogenase" refers to an enzyme that catalyzes the conversion of isobutyryl-CoA to isobutyraldehyde, using either NADH or NADPH as electron donor. Examples of acylating aldehyde dehydrogenases are known by the EC numbers 1.2.1.10 and 1.2.1.57. These enzymes are available from multiple sources, including, but not limited to, *Clostridium beijerinckii* (GenBank Nos: AAD31841 and AF157306), *C. acetobutylicum* (GenBank Nos: NP_149325, NC_001988, NP_149199, and NC_001988), *P. putida* (GenBank Nos: AAA89106 and U13232), and *Thermus thermophilus* (GenBank Nos: YP_145486 and NC_006461).

The term "transaminase" refers to an enzyme that catalyzes the conversion of α-ketoisovalerate to L-valine, using either alanine or glutamate as amine donor. Examples of transaminases are known by the EC numbers 2.6.1.42 and 2.6.1.66. These enzymes are available from a number of sources. Examples of sources for alanine-dependent enzymes include, but are not limited to, *E. coli* (GenBank Nos: YP_026231 and NC_000913) and *Bacillus licheniformis* (GenBank Nos: YP_093743 and NC_006322). Examples of sources for glutamate-dependent enzymes include, but are not limited to, *E. coli* (GenBank Nos: YP_026247 and NC_000913), *S. cerevisiae* (GenBank Nos: NP_012682 and NC_001142) and *Methanobacterium thermoautotrophicum* (GenBank Nos: NP_276546 and NC_000916).

The term "valine dehydrogenase" refers to an enzyme that catalyzes the conversion of α-ketoisovalerate to L-valine, using NAD(P)H as electron donor and ammonia as amine donor. Examples of valine dehydrogenases are known by the EC numbers 1.4.1.8 and 1.4.1.9 and are available from a number of sources, including, but not limited to, *Streptomyces coelicolor* (GenBank Nos: NP_628270 and NC_003888) and *B. subtilis* (GenBank Nos: CAB14339 and Z99116).

The term "valine decarboxylase" refers to an enzyme that catalyzes the conversion of L-valine to isobutylamine and $CO_2$. Examples of valine decarboxylases are known by the EC number 4.1.1.14. These enzymes are found in Streptomycetes, such as for example, *Streptomyces viridifaciens* (GenBank Nos: AAN10242 and AY116644).

The term "omega transaminase" refers to an enzyme that catalyzes the conversion of isobutylamine to isobutyraldehyde using a suitable amino acid as amine donor. Examples of omega transaminases are known by the EC number 2.6.1.18 and are available from a number of sources, including, but not limited to, *Alcaligenes denitrificans* (GenBank Nos: AAP92672 and AY330220), *Ralstonia eutropha* (GenBank Nos: YP_294474 and NC_0073479), *Shewanella oneidensis* (GenBank Nos: NP_719046 and NC_004347), and *P. putida* (GenBank Nos: AAN66223 and AE016776).

The term "isobutyryl-CoA mutase" refers to an enzyme that catalyzes the conversion of butyryl-CoA to isobutyryl-CoA. This enzyme uses coenzyme $B_{12}$ as cofactor. Examples of isobutyryl-CoA mutases are known by the EC number 5.4.99.13. These enzymes are found in a number of Streptomycetes, including, but not limited to, *Streptomyces cinnamonensis* (GenBank Nos: AAC08713, U67612, CAB59633, and AJ246005), *S. coelicolor* (GenBank Nos: CAB70645, AL939123, CAB92663, and L939121), and *Streptomyces avermitilis* (GenBank Nos: NP_824008, NC_003155, NP_824637 and NC_003155).

The term "substantially free" when used in reference to the presence or absence of enzyme activities (e.g., pyruvate decarboxylase) in carbon pathways that compete with the present isobutanol pathway means that the level of the enzyme is substantially less than that of the same enzyme in the wildtype host, where less than about 20% of the wildtype level is preferred and less than about 15% or 10% of the wildtype level are more preferred. The activity can be less than about 5%, 4%, 3%, 2% or 1% of wildtype activity.

The term "a facultative anaerobe" refers to a microorganism that can grow in both aerobic and anaerobic environments.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof. Sources for carbon substrates can include any feedstock, such as renewable-source feedstocks, including but not limited to any sugar or starch containing biomass such as corn, wheat, sugar cane, wood, algae; any agricultural wastes or residues and any lignocellulosic and/or hemicellulosic materials.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene can comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism, e.g. by gene transfer, or is found or is native to a host organism but is modified in some way to affect its functioning. A polynucleotide integrated (whether a nature or non-native polynucleotide) into a chromosome as described herein is considered a heterologous polynucleotide. Foreign genes can comprise native genes inserted into a non-native organism, or chimeric genes. A "transgene" is a gene that has been introduced into the genome by a transformation procedure.

As used herein the terms "coding sequence" and "coding region" refer to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters can be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters." It is further recognized that because in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression" as used herein refers to the transcription and stable accumulation of sense (mRNA) or antisense RNA derived from the nucleic acid fragment of the invention. Expression can also refer to translation of mRNA into a polypeptide.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid", "vector" and "cassette" refer to an extra chromosomal element often carrying genes which are not part of the central metabolism of the cell, and usually in the form of circular double-stranded DNA fragments. Such elements can be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

As used herein, the term "codon degeneracy" refers to the nature of the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "endogenous" as used herein refers to something that is produced or synthesized by the organism or that is added to the surroundings of the organism.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

As used herein, an "isolated nucleic acid fragment" or "isolated nucleic acid molecule" are used interchangeably and mean a polymer of RNA or DNA that is single- or double-stranded, optionally containing synthetic, non-natural or altered nucleotide bases. An isolated nucleic acid fragment in the form of a polymer of DNA can be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. Another set of stringent conditions uses higher temperatures in which the washes are identical to those above except for the temperature of the final two 30 min washes in 0.2×SSC, 0.5% SDS was increased to 60° C. Another set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. In another embodiment, a minimum length for a hybridizable nucleic acid is at least about 15 nucleotides, at least about 20 nucleotides, or at least about 30 nucleotides. Furthermore, the skilled artisan will recognize that the temperature and wash solution salt concentration can be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides can be used in sequence-dependent methods of gene identification (e.g., Southern hybridization) and isolation (e.g., in situ hybridization of bacterial colonies or bacteriophage plaques). In addition, short oligonucleotides of 12-15 bases can be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular fungal proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity," as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: (1) *Computational Molecular Biology* (Lesk, A. M., Ed.) Oxford University: NY (1988); (2) *Biocomputing: Informatics and Genome Projects* (Smith, D. W., Ed.) Academic: NY (1993); (3) *Computer Analysis of Sequence Data, Part I* (Griffin, A. M., and Griffin, H. G., Eds.) Humania: NJ (1994); (4) *Sequence Analysis in Molecular Biology* (von Heinje, G., Ed.) Academic (1987); and (5) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins et al., *CABIOS.* 5:151-153, 1989; Higgins et al., *Comput. Appl. Biosci.,* 8:189-191, 1992) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins et al., *CABIOS.* 5:151-153 (1989); Higgins et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 24%, 30%, 35%, 40%, 45%, 50%, 55%, 60%, 65%, 70%, 75%, 80%, 85%, 90%, or 95%, or any integer percentage from 24% to 100% may be useful in describing the present invention, such as 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, at least 100 amino acids, at least 150 amino acids, at least 200 amino acids, or at least 250 amino acids.

The term "sequence analysis software" refers to any computer algorithm or software program that is useful for the analysis of nucleotide or amino acid sequences. "Sequence analysis software" can be commercially available or independently developed. Typical sequence analysis software will include, but is not limited to: (1) the GCG suite of programs (Wisconsin Package Version 9.0, Genetics Computer Group (GCG), Madison, Wis.); (2) BLASTP, BLASTN, BLASTX (Altschul et al., *J. Mol. Biol.,* 215:403-410 (1990)); (3) DNASTAR (DNASTAR, Inc. Madison, Wis.); (4) Sequencher (Gene Codes Corporation, Ann Arbor, Mich.); and (5) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods are in *Methods in Enzymology,* Volume 194, *Guide to Yeast Genetics and Molecular and Cell Biology* (Part A, 2004, Christine Guthrie and Gerald R. Fink (Eds.), Elsevier Academic Press, San Diego, Calif.). Other molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 Jan. 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology, Volume 201, Issue 2, Pages 405-421; Albert, et al. (1995) The Plant Journal. Volume 7, Issue 4, pages 649-659), "seamless" gene deletion (Akada, et al. (2006) Yeast; 23(5): 399-405), and gap repair methodology (Ma et al., *Genetics* 58:201-216; 1981).

Biosynthetic Pathway Production Through Conversion of Pyruvate to Acetolactate

Figure 2:
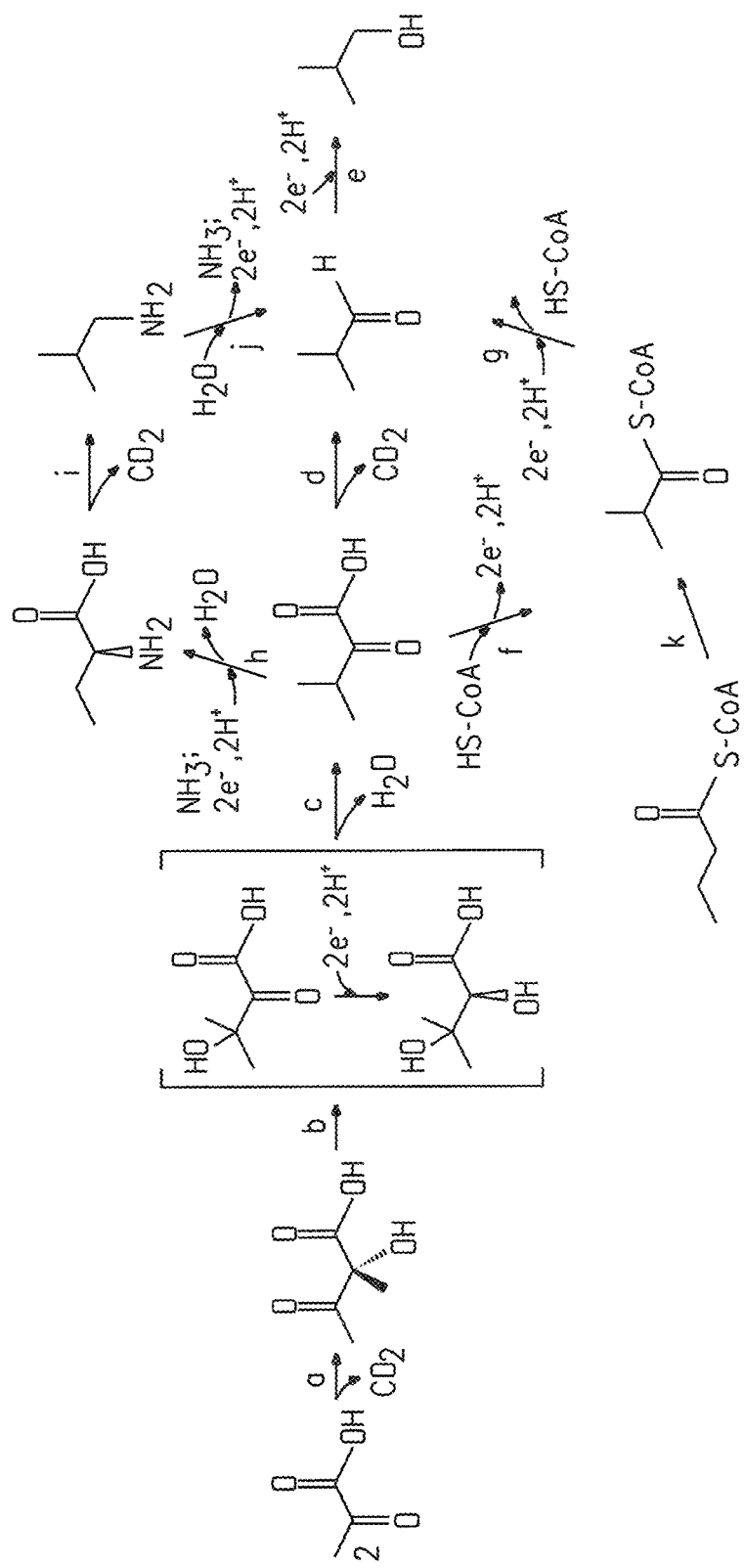
FIG. 2 shows three different isobutanol biosynthetic pathways
Figure 3:
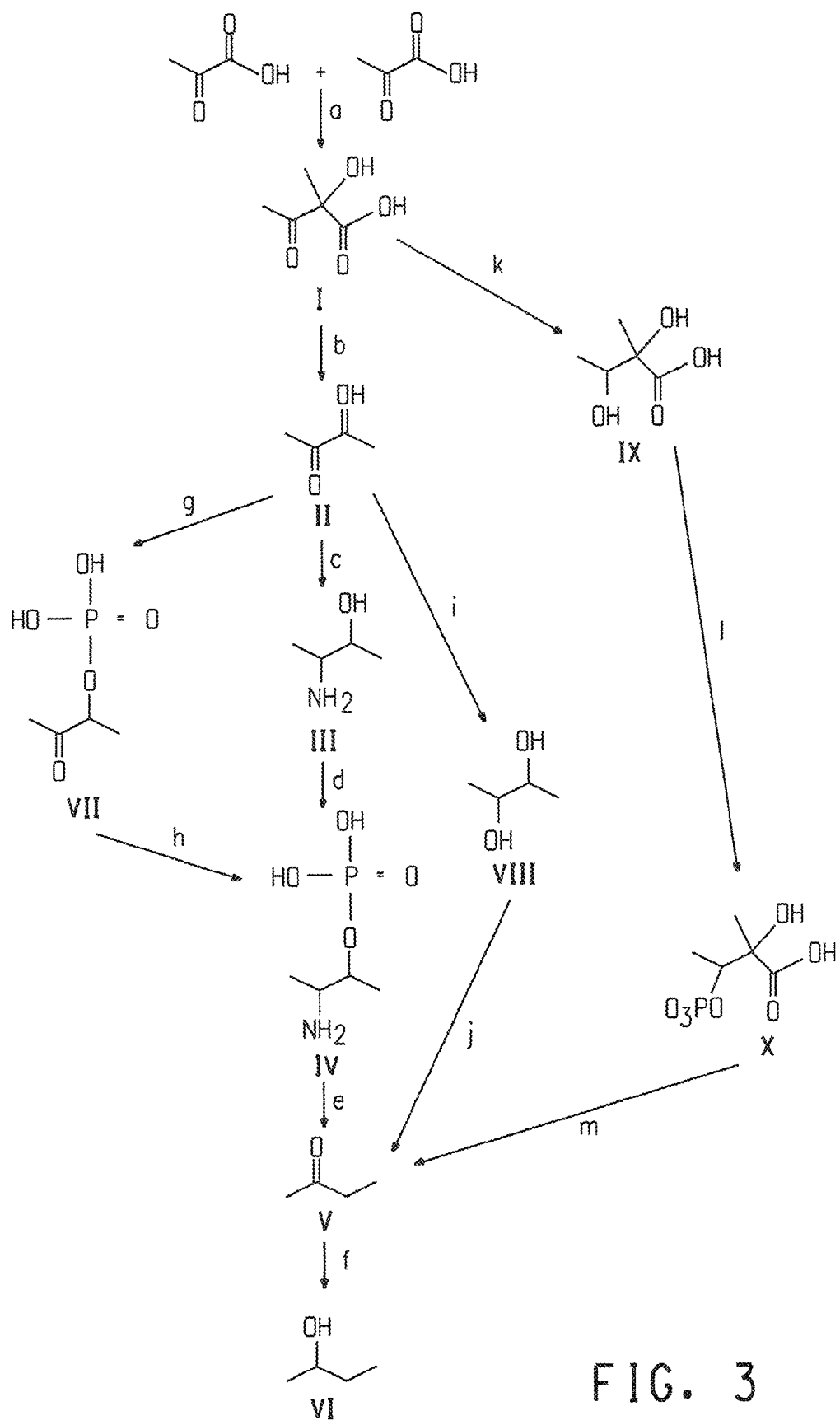
FIG. 3 shows four different 2-butanol biosynthetic pathways.

Microbial cells produce pyruvate from sugars, which is then utilized in a number of pathways of cellular metabolism including those shown in FIG. 1. Microbial host cells can be engineered to produce a number of desirable products with the initial biosynthetic pathway step being conversion of endogenous pyruvate to acetolactate. Engineered biosynthetic pathways for synthesis of isobutanol (FIG. 2) are described in U.S. Appl. Pub. No. 20070092957, which is herein incorporated by reference, and for synthesis of 2-butanol and 2-butanone (FIG. 3) are described in U.S. Appl. Pub. Nos. 20070259410 and 20070292927, which are herein incorporated by reference. The product 2,3-butanediol is an intermediate in the biosynthetic pathway described in U.S. Appl. Pub. No. 20070292927. Each of these pathways has the initial step of converting pyruvate to acetolactate by acetolactate synthase. Therefore, product yield from these biosynthetic pathways will in part depend upon the amount of acetolactate that can be produced from pyruvate and the amount of pyruvate that is available.

Applicants have discovered that a recombinant host cell comprising a polynucleotide encoding a polypeptide which catalyzes the conversion of pyruvate to acetolactate integrated into the chromosome of the host cell can have improved production of a product of a pyruvate-utilizing biosynthetic pathway (e.g., a butanol such as isobutanol). Applicants found that host cells of the invention can have improved butanol production as shown by increased product titer, increased production rate or increased cell density compared to cells wherein the polynucleotide is not integrated into the chromosome.

In embodiments, the present invention relates to a recombinant host cell comprising a pyruvate-utilizing biosynthetic pathway and a polynucleotide encoding a polypeptide which catalyzes the conversion of pyruvate to acetolactate integrated into the chromosome of the host cell. In embodiments, the polynucleotide is heterologous to the host cell. In embodiments, the pyruvate-utilizing biosynthetic pathway comprises one or more polynucleotides encoding a polypeptide that catalyzes substrate to product conversions of the pathway. In embodiments, one or more of the polynucleotides are integrated into the chromosome of the host cell.

Expression and Integration of Acetolactate Synthase

In embodiments of the invention, a polypeptide that catalyzes a substrate to product conversion of pyruvate to acetolactate is an acetolactate synthase. Endogenous acetolactate synthase in a host cell of the invention can be encoded in the mitochondrial genome and expressed in the mitochondria. In embodiments, to prepare a recombinant host cell of the present invention (such as yeast), a genetic modification is made that provides cytosolic expression of acetolactate synthase. In such embodiments, acetolactate synthase is expressed from the nucleus and no mitochondrial targeting signal is included so that the enzyme remains in the cytosol (cytosol-localized). Cytosolic expression of acetolactate synthase is described in US Application Publication No. 20090305363.

Acetolactate synthase enzymes, which also can be called acetohydroxy acid synthase, belong to EC 2.2.1.6 (switched from 4.1.3.18 in 2002), and are well-known. These enzymes participate in the biosynthetic pathway for the proteinogenic amino acids leucine and valine, as well as in the pathway for fermentative production of 2,3-butanediol and acetoin in a number of organisms.

The skilled person will appreciate that polypeptides having acetolactate synthase activity isolated from a variety of sources can be useful in the present invention independent of sequence homology. Suitable acetolactate synthase enzymes are available from a number of sources, as described in the definitions. Acetolactate synthase enzyme activities that have substrate preference for pyruvate over ketobutyrate are of particular utility, such as those encoded by alsS of *Bacillus* and budB of *Klebsiella* (Gollop et al., *J. Bacteriol.* 172(6): 3444-3449, 1990; and Holtzclaw et al., *J. Bacteriol.* 121(3): 917-922, 1975).

Because acetolactate synthases are well known, and because of the prevalence of genomic sequencing, suitable acetolactate synthases can be readily identified by one skilled in the art on the basis of sequence similarity using bioinformatics approaches. Typically BLAST (described above) searching of publicly available databases with known acetolactate synthase amino acid sequences, such as those provided herein, is used to identify acetolactate synthases, and their encoding sequences, that may be used in the present strains. For example, acetolactate synthases that are the 100 closest neighbors of the *B. subtilis* AlsS sequence are depicted in a phylogenetic tree in FIG. 4. The homology relationships between the sequences identified are shown in this tree. Among these sequences are those having 40% identity, yet these have been verified as acetolactate synthases. Acetolactate synthase proteins having at least about 70-75%, 75%-80%, 80-85%, 85%-90%, 90%-95% or at least about 98% or 99% sequence identity to any of the acetolactate synthase proteins in Table 1, or any of the acetolactate synthase proteins represented in FIG. 4 can be used in the present strains. Identities are based on the Clustal W method of alignment using the default parameters of GAP PENALTY=10, GAP LENGTH PENALTY=0.1, and Gonnet 250 series of protein weight matrix.

Figure 4A:
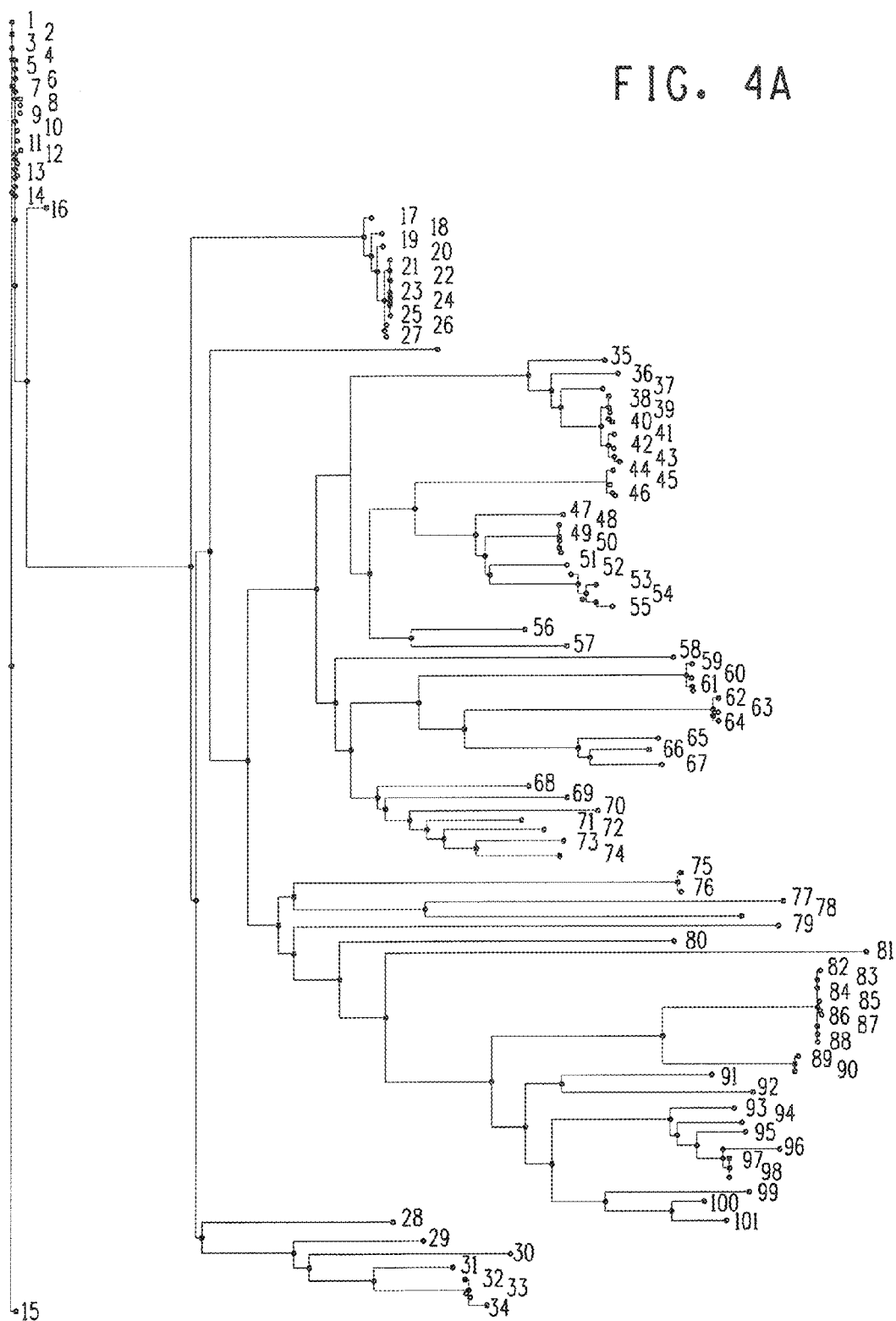

Examples of sequences encoding acetolactate synthase which can be used to provide cytosolic expression of acetolactate synthase (als) activity are listed in Table 1. Additional acetolactate synthase encoding sequences that can be used for yeast cytosolic expression can be identified in the literature and in bioinformatics databases well known to the skilled person, and some coding regions for als proteins are represented in FIG. 4 by the source organism. Any als having EC number 2.2.1.6 can be identified by one skilled in the art and can be used in the present host cells.

Additionally, the sequences described herein or those recited in the art can be used to identify other homologs in nature. For example, each of the acetolactate synthase encoding nucleic acid fragments described herein may be used to isolate genes encoding homologous proteins. Isolation of homologous genes using sequence-dependent protocols is well known in the art. Examples of sequence-dependent protocols include, but are not limited to, (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor et al., *Proc. Acad. Sci. USA* 82:1074, 1985; or strand displacement amplification (SDA), Walker et al., *Proc. Natl. Acad. Sci. U.S.A.,* 89:392, 1992]; and (3) methods of library construction and screening by complementation.

For example, genes encoding similar proteins or polypeptides to the acetolactate synthase encoding genes described herein can be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein et al., "The use of oligonucleotides as specific hybridization probes in the Diagnosis of Genetic Disorders," in *Human Genetic Diseases: A Practical Approach*, K. E. Davis Ed., 1986, pp. 33-50, IRL: Herndon et al., In *Methods in Molecular Biology*, White, B. A. Ed., (1993) Vol. 15, pp. 31-39, PCR Protocols: Current Methods and Applications. Humania: Totowa, N.J.).

Generally two short segments of the described sequences can be used in polymerase chain reaction protocols to amplify longer nucleic acid fragments encoding homologous genes from DNA or RNA. The polymerase chain reaction can also be performed on a library of cloned nucleic acid fragments wherein the sequence of one primer is derived from the described nucleic acid fragments, and the sequence of the other primer takes advantage of the presence of the polyadenylic acid tracts to the 3' end of the mRNA precursor encoding microbial genes.

Alternatively, the second primer sequence can be based upon sequences derived from the cloning vector. For example, the skilled artisan can follow the RACE protocol (Frohman et al., *PNAS USA* 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (e.g., BRL, Gaithersburg, Md.), specific 3' or 5' cDNA fragments can be isolated (Ohara et al., *PNAS USA* 86:5673, 1989; Loh et al., *Science* 243:217, 1989).

Alternatively, the described acetolactate synthase encoding sequences can be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. The probe length can vary from 5 bases to tens of thousands of bases, and can depend upon the specific test to be done. Typically a probe length of about 15 bases to about 30 bases is suitable. However, only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid can occur. The concentration of probe or target in the mixture will determine the time necessary for hybridization to occur. The higher the probe or target concentration, the shorter the hybridization incubation time needed. Optionally, a chaotropic agent may be added. The chaotropic agent stabilizes nucleic acids by inhibiting nuclease activity. Furthermore, the chaotropic agent allows sensitive and stringent hybridization of short oligonucleotide probes at room temperature (Van Ness et al., *Nucl. Acids Res.* 19:5143-5151, 1991). Suitable chaotropic agents include, but are not limited to, guanidinium chloride, guanidinium thiocyanate, sodium thiocyanate, lithium tetrachloroacetate, sodium perchlorate, rubidium tetrachloroacetate, potassium iodide and cesium trifluoroacetate, among others. The chaotropic agent can be present at a final concentration of about 3 M. If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal) and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives can also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats such as the sandwich assay format. The sandwich assay is particularly adaptable to hybridization under non-denaturing conditions. A primary component of a sandwich-type assay is a solid support. The solid support has adsorbed to it or covalently coupled to it immobilized nucleic acid probe that is unlabeled and complementary to one portion of the sequence.

Cytosolic expression of acetolactate synthase can be achieved by transforming with a gene comprising a sequence encoding an acetolactate synthase protein, with no mitochondrial targeting signal sequence. Methods for gene expression in yeasts are known in the art (see, e.g., *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Expression of genes in yeast typically requires a promoter, operably linked to a coding region of interest, and a transcriptional terminator. A number of yeast promoters can be used in constructing expression cassettes for genes encoding an acetolactate synthase, including, but not limited to constitutive promoters FBA, GPD1, ADH1, and GPM, and the inducible promoters GAL1, GAL10, and CUP1. Other yeast promoters include hybrid promoters UAS(PGK1)-FBA1p (SEQ ID NO: 238), UAS(PGK1)-ENO2p (SEQ ID NO: 239), UAS (FBA1)-PDC1p (SEQ ID NO: 240), UAS(PGK1)-PDC1p (SEQ ID NO: 241), and UAS(PGK)-OLE1p (SEQ ID NO: 242). Suitable transcriptional terminators include, but are not limited to FBAt, GPDt, GPMt, ERG10t, GAL1t, CYC1, and ADH1.

Suitable promoters, transcriptional terminators, and coding regions can be cloned into a yeast 2 micron plasmid and transformed into yeast cells (Ludwig, et al. Gene, 132: 33-40, 1993; US Appl. Pub. No. 20080261861A1).

Suitable promoters, transcriptional terminators, and coding regions can be cloned into *E. coli*-yeast shuttle vectors, and transformed into yeast cells as described in the Examples. These vectors allow strain propagation in both *E. coli* and yeast strains.

Typically the vector contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2μ origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with a chimeric gene encoding a polypeptide can be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a ≥21 bp sequence at both the 5' and the 3' ends that sequentially overlap with each other, and with the 5' and 3' terminus of the vector DNA. For example, to construct a yeast expression vector for "Gene X," a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g., TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE (splicing by overlap extension) PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA. Alternatively, an integration vector can be constructed and propagated in *E. coli*. Elements necessary for chromosomal integration (at least one host-specific targeting sequence and a yeast selectable marker) can be added to any suitable *E. coli* cloning vector. After preparing the vector from the *E. coli* host, it can be linearized by restriction digestion within the host-specific targeting sequence and transformed into yeast. Homologous recombination between the linearized vector and the native targeting sequence will result in integration of the entire vector (Rothstein, R., Methods in Enzymology, Vol 194, pp. 281-301). Transformants are obtained by selection for the auxotrophic marker and confirmed by PCR method or direct sequencing.

In embodiments, the present invention is directed to a method of producing a recombinant host cell, comprising transforming a host cell with (i) at least one polynucleotide encoding a polypeptide that catalyzes a substrate to product conversion of a pyruvate-utilizing biosynthetic pathway; and (ii) a polynucleotide encoding a peptide that catalyzes the conversion of pyruvate to acetolactate; wherein the polynucleotide of (ii) is integrated into the chromosome.

Biosynthetic Pathways

Suitable biosynthetic pathways for production of butanol are known in the art, and certain suitable pathways are described herein. In some embodiments, the butanol, including isobutanol biosynthetic pathway comprises at least one gene that is heterologous to the host cell. In some embodiments, the butanol biosynthetic pathway comprises more than one gene that is heterologous to the host cell. In some embodiments, the butanol biosynthetic pathway comprises heterologous genes encoding polypeptides corresponding to every step of a biosynthetic pathway. As used herein heterologous refers to both native and non-native genes that have been modified for the purposes herein.

Products of pyruvate-utilizing biosynthetic pathway can be advantageously produced in a host cell of the invention. A list of such products includes, but is not limited to, 2,3-butanediol, 2-butanone, 2-butanol, and isobutanol. In embodiments, the pyruvate-utilizing biosynthetic pathway comprises one or more polynucleotides encoding a polypeptide that catalyzes a substrate to product conversion of the pathway. In embodiments, the one or more polynucleotides are integrated into a chromosome of the host cell.

In some embodiments, the invention relates to a recombinant host cell comprising a first heterologous polynucleotide encoding a first polypeptide which catalyzes the conversion of a step of a pyruvate-utilizing biosynthetic pathway; a second heterologous polynucleotide encoding a second polypeptide which catalyzes the conversion of a step of a pyruvate-utilizing biosynthetic pathway; and a third heterologous polynucleotide encoding a third polypeptide which catalyzes the conversion of a step of a pyruvate-utilizing biosynthetic pathway; wherein the first and second heterologous polynucleotides are integrated into the chromosome of the host cell; wherein the third heterologous polynucleotide is not integrated into the chromosome of the host cell; and wherein the first, second, and third polypeptides catalyze different steps of the pyruvate-utilizing biosynthetic pathway.

In some embodiments, the invention relates to a recombinant host cell comprising (a) a first heterologous polynucleotide encoding a first polypeptide which catalyzes a substrate to product conversion of pyruvate to acetolactate; (b) a second heterologous polynucleotide encoding a second polypeptide which catalyzes the substrate to product conversion of α-ketoisovalerate to isobutyraldehyde; and (c) a third heterologous polynucleotide encoding a third polypeptide which catalyzes the conversion of a step of a isobutanol biosynthetic pathway that is not the conversion of (a) or (b); wherein the first and second heterologous polynucleotides are integrated into the chromosome; wherein the third heterologous polynucleotide is not integrated into the chromosome; and wherein the host cell produces isobutanol.

In some embodiments, the invention relates to a recombinant host cell comprising (a) a first heterologous polynucleotide encoding a first polypeptide which catalyzes a substrate to product conversion of α-ketoisovalerate to isobutyraldehyde; and (b) a second heterologous polynucleotide encoding a second polypeptide which catalyzes the conversion of a step of a isobutanol biosynthetic pathway that is not the conversion of (a); wherein the first heterologous polynucleotide is integrated into the chromosome; wherein the second heterologous polynucleotide is not integrated into the chromosome; and wherein the host cell produces isobutanol.

Biosynthetic pathways starting with a step of converting pyruvate to acetolactate for synthesis of isobutanol are disclosed in U.S. Appl. Pub. No. 20070092957, which is herein incorporated by reference. As described in U.S. U.S. Appl. Pub. No. 20070092957, steps in an example isobutanol biosynthetic pathway using acetolactate include conversion of:

acetolactate to 2,3-dihydroxyisovalerate (FIG. 2 pathway step b) as catalyzed for example by acetohydroxy acid isomeroreductase;
2,3-dihydroxyisovalerate to α-ketoisovalerate (FIG. 2 pathway step c) as catalyzed for example by acetohydroxy acid dehydratase;
α-ketoisovalerate to isobutyraldehyde (FIG. 2 pathway step d) as catalyzed for example by branched-chain α-keto acid decarboxylase; and
isobutyraldehyde to isobutanol (FIG. 2 pathway step e) as catalyzed for example by branched-chain alcohol dehydrogenase.

Genes and polypeptides that can be used for substrate to product conversions described herein as well as methods of identifying such genes and polypeptides, are described herein and/or in the art, for example, for isobutanol, in the Examples and in U.S. Pat. No. 7,851,188. Ketol-acid reductoisomerase enzymes are described in U.S. Patent Appl. Pub. Nos. 20080261230 A1, 20090163376 A1, 20100197519 A1, and PCT Appl. Pub. No. WO/2011/041415. Examples of KARIs disclosed therein are those from *Lactococcus lactis, Vibrio cholera, Pseudomonas aeruginosa* PAO1, as well as *Pseudomonas fluorescens* PF5 mutants. KARIs include *Anaerostipes caccae* KARI variants "K9G9" and "K9D3" (amino acid sequences SEQ ID NOs: 225 and 224, respectively). US Appl. Pub. No. 20100081154 A1, and U.S. Pat. No. 7,851,188 describe dihydroxyacid dehydratases (DHADs), including a DHAD from *Streptococcus mutans*. Suitable polypeptides to catalyze the conversion of α-ketoisovalerate to isobutyraldehyde include those from *Listeria grayi, Lactococcus lactis*, and *Macrococcus caseolyticus* having SEQ ID NOs: 247, 48, and 248, respectively. U.S. Patent Appl. Publ. No. 20090269823 A1 describes SadB, an alcohol dehydrogenase (ADH) from *Achromobacter xylosoxidans*. Alcohol dehydrogenases also include horse liver ADH and *Beijerinkia indica* ADH (protein SEQ ID NO: 237). Each of the above-referenced applications and patents is herein incorporated by reference.

Also described in U.S. Appl. Pub. No. 20070092957 is the construction of chimeric genes and genetic engineering of yeast, exemplified by *Saccharomyces cerevisiae*, for isobutanol production using the disclosed biosynthetic pathways.

In some embodiments, the isobutanol biosynthetic pathway comprises at least one gene, at least two genes, at least three genes, or at least four genes that is/are heterologous to the yeast cell. In some embodiments, the recombinant host cell comprises a heterologous gene for each substrate to product conversion of an isobutanol biosynthetic pathway. In embodiments, the polypeptide catalyzing the substrate to product conversions of acetolactate to 2,3-dihydroxyisovalerate and/or the polypeptide catalyzing the substrate to product conversion of isobutyraldehyde to isobutanol are capable of utilizing NADH as a cofactor.

Biosynthetic pathways starting with a step of converting pyruvate to acetolactate for synthesis of 2-butanone and 2-butanol are disclosed in U.S. Appl. Pub. Nos. 20070259410 and 20070292927, which are herein incorporated by reference. A diagram of the disclosed 2-butanone and 2-butanol biosynthetic pathways is provided in FIG. 3. 2-Butanone is the product made when the last depicted step of converting 2-butanone to 2-butanol is omitted. Production of 2-butanone or 2-butanol in a strain disclosed herein benefits from increased availability of acetolactate. As described in U.S. Appl. Pub. No. 20070292927, steps in an example biosynthetic pathway using acetolactate include conversion of:

acetolactate to acetoin (FIG. 3 step b) as catalyzed for example by acetolactate decarboxylase;
acetoin to 2,3-butanediol (FIG. 3 step i) as catalyzed for example by butanediol dehydrogenase;
2,3-butanediol to 2-butanone (FIG. 3 step j) as catalyzed for example by diol dehydratase or glycerol dehydratase; and
2-butanone to 2-butanol (FIG. 3 step f) as catalyzed for example by butanol dehydrogenase.

Genes that can be used for expression of these enzymes are described in U.S. Appl. Pub. No. 20070292927. The use in this pathway in yeast of the butanediol dehydratase from *Roseburia inulinivorans*, RdhtA, (protein SEQ ID NO:32, coding region SEQ ID NO:31) is disclosed in U.S. Appl. Pub. No. 20090155870. This enzyme is used in conjunction with the butanediol dehydratase reactivase from *Roseburia inulinivorans*, RdhtB, (protein SEQ ID NO:34, coding region SEQ ID NO:33).

As described in U.S. Appl. Pub. No. 20070292927, steps in an example biosynthetic pathway using acetolactate include conversion of:

alpha-acetolactate to acetoin (FIG. 3 step b) as catalyzed for example by acetolactate decarboxylase;
acetoin to 3-amino-2-butanol (FIG. 3 step c) as catalyzed for example by acetoin aminase;
3-amino-2-butanol to 3-amino-2-butanol phosphate (FIG. 3 step d) as catalyzed for example by aminobutanol kinase;

3-amino-2-butanol phosphate to 2-butanone (FIG. 3 step e) as catalyzed for example by aminobutanol phosphate phosphor-lyase; and 2-butanone to 2-butanol (FIG. 3 step f) as catalyzed for example by butanol dehydrogenase.

2-Butanone is the product made when the last depicted step of converting 2-butanone to 2-butanol is omitted. Production of 2-butanone or 2-butanol in a strain disclosed herein benefits from increased availability of acetolactate.

Useful for the last step of converting 2-butanone to 2-butanol is a new butanol dehydrogenase isolated from an environmental isolate of a bacterium identified as *Achromobacter xylosoxidans* that is disclosed in U.S. Pub. Appl. No. 20090269823 (DNA: SEQ ID NO:35, protein SEQ ID NO:36).

Also described in U.S. Pub. Appl. No. 20090155870 is the construction of chimeric genes and genetic engineering of yeast for 2-butanol production using the U.S. Appl. Pub. No. 20070292927 disclosed biosynthetic pathway. 2,3-butanediol is an intermediate in this 2-butanol pathway and the steps in its synthesis are also described above.

In embodiments of the invention, the pyruvate-utilizing biosynthetic pathway forms a product that includes 2,3-butanediol, isobutanol, 2-butanol or 2-butanone. In embodiments, the pyruvate-utilizing biosynthetic pathway is a butanol biosynthetic pathway. In embodiments, the butanol biosynthetic pathway is a 2-butanol biosynthetic pathway or an isobutanol biosynthetic pathway. In embodiments, the host cell comprises at least one polynucleotide encoding a polypeptide that catalyzes a substrate to product conversion of (i) pyruvate to acetolactate; (ii) acetolactate to 2,3-dihydroxyisovalerate; (iii) 2,3-dihydroxyisovalerate to α-ketoisovalerate; (iv) α-ketoisovalerate to isobutyraldehyde; or (v) isobutyraldehyde to isobutanol. In embodiments, the host cell comprises at least one polynucleotide encoding a polypeptide that catalyzes a substrate to product conversion of (i) pyruvate to acetolactate; (ii) acetolactate to 2,3-dihydroxyisovalerate; (iii) 2,3-dihydroxyisovalerate to α-ketoisovalerate; (iv) α-ketoisovalerate to isobutyryl-CoA; (v) isobutyryl-CoA to isobutyraldehyde; or (vi) isobutyraldehyde to isobutanol. In other embodiments, the host cell comprises at least one polynucleotide encoding a polypeptide that catalyzes a substrate to product conversion of (i) pyruvate to acetolactate; (ii) acetolactate to 2,3-dihydroxyisovalerate; (iii) 2,3-dihydroxyisovalerate to α-ketoisovalerate; (iv) α-ketoisovalerate to valine; (v) valine to isobutylamine; (vi) isobutylamine to isobutyraldehyde; or (vii) isobutyraldehyde to isobutanol.

In embodiments, the host cell comprises at least one polynucleotide encoding a polypeptide that catalyzes a substrate to product conversion of (i) pyruvate to acetolactate; (ii) acetolactate to acetoin; (iii) acetoin to 2,3-butanediol; or (iv) 2,3-butanediol to 2-butanone. In embodiments, the host cell comprises at least one polynucleotide encoding a polypeptide that catalyzes a substrate to product conversion of (i) pyruvate to acetolactate; (ii) acetolactate to acetoin; (iii) acetoin to 2,3-butanediol; (iv) 2,3-butanediol to 2-butanone; or (v) 2-butanone to 2-butanol.

In embodiments, the recombinant host cell comprises (a) a heterologous polynucleotide encoding a polypeptide which catalyzes the substrate to product conversion of pyruvate to acetolactate, wherein the polynucleotide is integrated into the chromosome; (b) a heterologous polynucleotide encoding a polypeptide which catalyzes the substrate to product conversion of acetolactate to 2,3-dihydroxyisovalerate; (c) a heterologous polynucleotide encoding a polypeptide which catalyzes the substrate to product conversion of 2,3-dihydroxyisovalerate to α-ketoisovalerate; and (d) a heterologous polynucleotide encoding a polypeptide which catalyzes the substrate to product conversion of α-ketoisovalerate to isobutyraldehyde, wherein the host cell is substantially free of pyruvate decarboxylase activity; and wherein the host cell produces isobutanol.

In embodiments, the polypeptide which catalyzes the conversion of acetolactate to 2,3-dihydroxyisovalerate corresponds to the Enzyme Commission Number EC 1.1.1.86. In embodiments, the polypeptide which catalyzes the conversion of 2,3-dihydroxyisovalerate to α-ketoisovalerate corresponds to the Enzyme Commission Number EC 4.2.1.9. In embodiments, the polypeptide which catalyzes the conversion of α-ketoisovalerate to isobutyraldehyde corresponds to the Enzyme Commission Number EC 4.1.1.72 or 4.1.1.1. In other embodiments, the polypeptide which catalyzes the conversion of isobutyraldehyde to isobutanol corresponds to the Enzyme Commission Number EC 1.1.1.265, 1.1.1.1 or 1.1.1.2.

In other embodiments of the invention, one or more of the polynucleotides encoding a polypeptide which catalyzes the conversion of any of the biosynthetic pathway steps described herein are on a plasmid. In embodiments, one or more polynucleotides encoding a polypeptide which catalyzes the conversion of any of the biosynthetic pathway steps described herein are integrated into the chromosome at the PDC1-TRX1 intergenic region.

In other embodiments, the host cells of the invention can have reduced or substantially eliminated expression of a polypeptide which catalyzes the conversion of glycerol-3-phosphate into dihydroxyacetone phosphate. In embodiments, the polypeptide which catalyzes the conversion of glycerol-3-phosphate into dihydroxyacetone phosphate is glycerol-3-phosphate dehydrogenase (GPD). In embodiments, the host cell comprises a deletion, mutation, and/or substitution in an endogenous polynucleotide encoding a polypeptide which catalyzes the conversion of glycerol-3-phosphate into dihydroxyacetone phosphate. In embodiments, the polypeptide which catalyzes the conversion of glycerol-3-phosphate into dihydroxyacetone phosphate corresponds to Enzyme Commission Number 1.1.1.8. In embodiments, the polynucleotide encoding a polypeptide which catalyzes the conversion of glycerol-3-phosphate into dihydroxyacetone phosphate is GPD1 or GPD2. In embodiments, the polynucleotide encoding a polypeptide which catalyzes the conversion of glycerol-3-phosphate into dihydroxyacetone phosphate comprises a GPD sequence of Table 2. Such modifications and others to host cells are described in US Application Publication No. 20090305363.

In other embodiments, the host cells of the invention can have reduced or substantially eliminated expression of an iron regulatory protein. In embodiments, the host cells of the invention can have reduced or substantially eliminated expression of a polypeptide affecting iron-sulfur (Fe—S) cluster biosynthesis. In embodiments, recombinant host cells further comprise (a) at least one heterologous polynucleotide encoding a polypeptide having dihydroxy-acid dehydratase activity; and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In embodiments, the polypeptide affecting Fe—S cluster biosynthesis is encoded by AFT/ (nucleic acid SEQ ID NO: 227, amino acid SEQ ID NO: 228), AFT2 (SEQ ID NOs: 229 and 230), FRA2 (SEQ ID NOs: 231 and 232), GRX3 (SEQ ID NOs: 233 and 234), or CCC1 (SEQ ID NOs: 235 and 236). In embodiments, the polypeptide affecting Fe—S cluster biosynthesis is constitutive mutant AFT1 L99A, AFT1 L102A, AFT1 C291F, or AFT1 C293F. In embodiments, the polypeptide affecting Fe—S cluster biosynthesis is selected from AFT1, AFT2, PSE1, FRA2, GRX3, MSN5, or combinations thereof. In embodiments, the host cell comprises a deletion, mutation, and/or substitution in an endogenous polynucleotide encoding an iron regulatory protein. In embodiments, the host cell comprises a deletion, mutation, and/or substitution in an endogenous polynucleotide encoding a polypeptide which affects Fe—S cluster biosynthesis. In embodiments, the polynucleotide encoding a polypeptide which affects Fe—S cluster biosynthesis comprises a sequence as disclosed in WIPO Appl. Pub. No. WO/2011/103300.

It will be appreciated that host cells comprising a butanol biosynthetic pathway such as an isobutanol biosynthetic pathway as provided herein may further comprise one or more additional modifications. U.S. Appl. Pub. No. 20090305363 (incorporated by reference) discloses increased conversion of pyruvate to acetolactate by engineering yeast for expression of a cytosol-localized acetolactate synthase and substantial elimination of pyruvate decarboxylase activity. Modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 20090305363 (incorporated herein by reference), modifications to a host cell that provide for increased carbon flux through an Entner-Doudoroff Pathway or reducing equivalents balance as described in U.S. Patent Appl. Pub. No. 20100120105 (incorporated herein by reference). Other modifications include at least one deletion, mutation, and/or substitution in an endogenous polynucleotide encoding a polypeptide having acetolactate reductase activity. In embodiments, the polypeptide having acetolactate reductase activity is YMR226c (SEQ ID NO: 226) of *Saccharomyces cerevisae* or a homolog thereof. Additional modifications include a deletion, mutation, and/or substitution in an endogenous polynucleotide encoding a polypeptide having aldehyde dehydrogenase and/or aldehyde oxidase activity. In embodiments, the polypeptide having aldehyde dehydrogenase activity is ALD6 (SEQ ID NO: 223) from *Saccharomyces cerevisiae* or a homolog thereof. A genetic modification which has the effect of reducing glucose repression wherein the yeast production host cell is pdc– is described in U.S. Appl. Publication No. 20110124060, incorporated herein by reference. Additionally, host cells may comprise heterologous polynucleotides encoding a polypeptide with phosphoketolase activity and/or a heterologous polynucleotide encoding a polypeptide with phosphotransacetylase activity as described in U.S. application Ser. No. 13/161,168, filed on Jun. 15, 2011, incorporated herein by reference. *Reduced Pyruvate Decarboxylase Activity*

Endogenous pyruvate decarboxylase activity in microbial cells converts pyruvate to acetaldehyde, which is then converted to ethanol or to acetyl-CoA via acetate (see FIG. 1). Microbial cells can have one or more genes encoding pyruvate decarboxylase. For example, in yeast there is one gene encoding pyruvate decarboxylase in *Kluyveromyces lactis*, while there are three isozymes of pyruvate decarboxylase encoded by the PDC1, PDC5, and PDC6 genes in *Saccharomyces cerevisiae*, as well as a pyruvate decarboxylase regulatory gene PDC2. Expression of pyruvate decarboxylase from PDC6 is minimal. In embodiments of the invention, host cells can have pyruvate decarboxylase activity that is reduced by disrupting at least one gene encoding a pyruvate decarboxylase, or a gene regulating pyruvate decarboxylase gene expression. For example, in *S. cerevisiae* the PDC1 and PDC5 genes, or all three genes, are disrupted. In addition, pyruvate decarboxylase activity can be reduced by disrupting the PDC2 regulatory gene in *S. cerevisiae*. In other yeasts, genes encoding pyruvate decarboxylase proteins such as those having at least about 80-85%, 85%-90%, 90%-95%, or at least about 98% sequence identity to PDC1 or PDC5 can be disrupted.

Examples of yeast strains with reduced pyruvate decarboxylase activity due to disruption of pyruvate decarboxylase encoding genes have been reported such as for *Saccharomyces* in Flikweert et al. (*Yeast*, 12:247-257, 1996), for *Kluyveromyces* in Bianchi et al. (*Mol. Microbiol.*, 19(1):27-36, 1996), and disruption of the regulatory gene in Hohmann (*Mol Gen Genet.*, 241:657-666, 1993). *Saccharomyces* strains having no pyruvate decarboxylase activity are available from the ATCC with Accession #200027 and #200028.

Expression of pyruvate decarboxylase genes can be reduced in any host cell that is also engineered with acetolactate synthase expression and other biosynthetic pathway enzyme encoding genes for production of a compound derived from acetolactate. Examples of yeast pyruvate decarboxylase genes that may be targeted for disruption are listed in Table 2 (SEQ ID NOs:50, 52, 54, 56, 58, 60, 62, 64 and 66). Other target genes, such as those encoding pyruvate decarboxylase proteins having at least about 80-85%, 85%-90%, 90%-95%, or at least about 98% or 99% sequence identity to the pyruvate decarboxylases listed in Table 2 (SEQ ID NOs: 51, 53, 55, 57, 59, 61, 63, 65 and 67) can be identified in the literature and in bioinformatics databases well known to the skilled person. Additionally, the sequences described herein or those recited in the art can be used to identify homologs in other yeast strains, as described above for identification of acetolactate synthase encoding genes.

Alternatively, because pyruvate decarboxylase encoding sequences are well known, and because sequencing of the genomes of yeasts is prevalent, suitable pyruvate decarboxylase gene targets can be identified on the basis of sequence similarity using bioinformatics approaches. Genomes have been completely sequenced and annotated and are publicly available for the following yeast strains: *Ashbya gossypii* ATCC 10895, *Candida glabrata* CBS 138, *Kluyveromyces lactis* NRRL Y-1140, *Pichia stipitis* CBS 6054, *Saccharomyces cerevisiae* S288c, *Schizosaccharomyces pombe* 972h-, and *Yarrowia lipolytica* CLIB122. Typically BLAST (described above) searching of publicly available databases with known pyruvate decarboxylase encoding sequences or pyruvate decarboxylase amino acid sequences, such as those provided herein, is used to identify pyruvate decarboxylase encoding sequences of other yeasts.

Accordingly it is within the scope of the invention to provide pyruvate decarboxylase proteins having at least about 70-75%, 75%-80%, 80-85%, 85%-90%, 90%-95% or at least about 98% or 99% sequence identity to any of the pyruvate decarboxylase proteins disclosed herein (SEQ ID NOs:51, 53, 55, 57, 59, 61, 63, 65 and 67). Identities are based on the Clustal W method of alignment using the default parameters of GAP PENALTY=10, GAP LENGTH PENALTY=0.1, and Gonnet 250 series of protein weight matrix.

In embodiments, the host cell of the invention can have expression of pyruvate decarboxylase, glycerol-3-phosphate dehydrogenase, an iron regulatory protein, and/or a polypeptide affecting iron-sulfur (Fe—S) cluster biosynthesis that is decreased or substantially eliminated. In other embodiments, the host cell comprises a deletion, mutation, and/or substitution in an endogenous polynucleotide encoding a polypeptide having the activity of pyruvate decarboxylase, glycerol-3- phosphate dehydrogenase, an iron regulatory protein, or a polypeptide affecting Fe—S cluster biosynthesis.

Genes encoding pyruvate decarboxylase, glycerol-3-phosphate dehydrogenase, an iron regulatory protein, or a polypeptide affecting Fe—S cluster biosynthesis can be disrupted in any host cell using genetic modification. Many methods for genetic modification of target genes are known to one skilled in the art and can be used to create the present yeast strains. Modifications that can be used to reduce or eliminate expression of a target protein are disruptions that include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed. In addition, expression of a gene can be blocked by expression of an antisense RNA or an interfering RNA, and constructs can be introduced that result in cosuppression. Moreover, a gene can be synthesized whose expression is low because rare codons are substituted for plentiful ones, and this gene substituted for the endogenous gene. Such a gene will produce the same polypeptide but at a lower rate. In addition, the synthesis or stability of the transcript may be lessened by mutation. Similarly the efficiency by which a protein is translated from mRNA may be modulated by mutation. All of these methods can be readily practiced by one skilled in the art making use of the known or identified gene sequences.

DNA sequences surrounding a coding sequence are also useful in some modification procedures and are available for yeasts such as for *Saccharomyces cerevisiae* in the complete genome sequence coordinated by Genome Project ID9518 of Genome Projects coordinated by NCBI (National Center for Biotechnology Information) with identifying GOPID #13838. Additional examples of yeast genomic sequences include that of *Yarrowia lipolytica*, GOPIC #13837, and of *Candida albicans*, which is included in GPID #10771, #10701 and #16373. Other yeast genomic sequences can be readily found by one of skill in the art in publicly available databases.

In particular, DNA sequences surrounding a gene coding sequence are useful for modification methods using homologous recombination. For example, in this method gene flanking sequences are placed bounding a selectable marker gene to mediate homologous recombination whereby the marker gene replaces the target gene. Also partial gene sequences and gene flanking sequences bounding a selectable marker gene may be used to mediate homologous recombination whereby the marker gene replaces a portion of the target gene. In addition, the selectable marker may be bounded by site-specific recombination sites, so that following expression of the corresponding site-specific recombinase, the resistance gene is excised from the target gene locus without reactivating the latter. The site-specific recombination leaves behind a recombination site which disrupts expression of the protein. A homologous recombination vector can be constructed to also leave a deletion in the target gene following excision of the selectable marker, as is well known to one skilled in the art.

Deletions can be made using mitotic recombination as described in Wach et al. (*Yeast*, 10:1793-1808, 1994). This method involves preparing a DNA fragment that contains a selectable marker between genomic regions that can be as short as 20 bp, and which bound a target DNA sequence. This DNA fragment can be prepared by PCR amplification of the selectable marker gene using as primers oligonucleotides that hybridize to the ends of the marker gene and that include the genomic regions that can recombine with the yeast genome. The linear DNA fragment can be efficiently transformed into yeast and recombined into the genome resulting in gene replacement including with deletion of the target DNA sequence (as described in "Methods in Enzymology," v194, pp 281-301, 1991).

In addition, the activity of pyruvate decarboxylase, glycerol-3-phosphate dehydrogenase, an iron regulatory protein, or a polypeptide affecting Fe—S cluster biosynthesis in any host cell of the invention can be disrupted using random mutagenesis, which is followed by screening to identify strains with reduced pyruvate decarboxylase activity. Using this type of method, the DNA sequence of the pyruvate decarboxylase encoding region, or any other region of the genome affecting expression of these activities, need not be known.

Methods for creating genetic mutations are common and well known in the art and may be applied to the exercise of creating mutants. Commonly used random genetic modification methods (reviewed in *Methods in Yeast Genetics*, 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of yeast commonly involves treatment of cells with one of the following DNA mutagens: ethyl methanesulfonate (EMS), nitrous acid, diethyl sulfate, or N-methyl-N'-nitro-N-nitroso-guanidine (MNNG). These methods of mutagenesis have been reviewed in Spencer et al (Mutagenesis in Yeast, 1996, *Yeast Protocols: Methods in Cell and Molecular Biology*. Humana Press, Totowa, N.J.). Chemical mutagenesis with EMS may be performed as described in *Methods in Yeast Genetics*, 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer et al. (Mutagenesis in Yeast, 1996, *Yeast Protocols Methods in Cell and Molecular Biology*. Humana Press, Totowa, N.J.). Introduction of a mutator phenotype can also be used to generate random chromosomal mutations in yeast. Common mutator phenotypes can be obtained through disruption of one or more of the following genes: PMS1, MAG1, RAD18 or RAD51. Restoration of the non-mutator phenotype can be easily obtained by insertion of the wildtype allele. Collections of modified cells produced from any of these or other known random mutagenesis processes may be screened for reduced activity of pyruvate decarboxylase, glycerol-3-phosphate decarboxylase, an iron regulatory protein or a polypeptide affecting Fe—S cluster biosynthesis.

Host Cells

The host cells of the invention can be any cell amenable to genetic manipulation. In embodiments, the host cell can be a bacterium, a cyanobacterium, a filamentous fungus, or a yeast. In embodiments, the host cell is a member of the genus *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula, Kluyveromyces,* or *Saccharomyces*. In other embodiments, the host cell is *Escherichia coli, Alcaligenes eutrophus, Bacillus licheniformis, Paenibacillus macerans, Rhodococcus erythropolis, Pseudomonas putida, Bacillus* subtilis, Lactobacillus plantarum, Enterococcus faecium, Enterococcus gallinarum, or Enterococcus faecalis.

Examples of a yeast include, but are not limited to, Saccharomyces, Schizosaccharomyces, Hansenula, Issatchenkia, Candida, Kluyveromyces, Yarrowia and Pichia. Examples of yeast strains include, but are not limited to, Saccharomyces cerevisiae, Schizosaccharomyces pombe, Kluyveromyces lactis, Kluyveromyces thermotolerans, Candida glabrata, Candida albicans, Pichia stipitis and Yarrowia lipolytica. In some embodiments, the host cell is Saccharomyces cerevisiae. S. cerevisiae yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. S. cerevisiae include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

In embodiments, the host cell of the invention is a facultative anaerobe. In embodiments, a cell used as a production host preferably has enhanced tolerance to the produced chemical, and/or can have a high rate of carbohydrate utilization. These characteristics can be conferred by mutagenesis and selection, genetic engineering, or can be natural.

Fermentation Media

A host cell of the invention can be grown in fermentation media that can contain suitable carbon substrates. Suitable substrates can include, but are not limited to, monosaccharides such as glucose and fructose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt. Additionally, the carbon substrate can also be one-carbon substrates such as carbon dioxide, or methanol for which metabolic conversion into key biochemical intermediates has been demonstrated. In addition to one and two carbon substrates, methylotrophic organisms can utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., Microb. Growth C1 Compd., [Int. Symp.], 7th (1993), 415-32. Editor(s): Murrell, J. Collin; Kelly, Don P. Publisher: Intercept, Andover, UK). Similarly, various species of Candida can metabolize alanine or oleic acid (Sulter et al., Arch. Microbiol. 153:485-489 (1990)). Hence, it is contemplated that the source of carbon utilized in the present invention can encompass a wide variety of carbon containing substrates.

In addition to a carbon source, fermentation media can contain suitable minerals, salts, cofactors, buffers and other components, known to those skilled in the art, suitable for the growth of the cultures and promotion of the enzymatic pathway necessary for production of the desired product.

Culture Conditions

Typically host cells of the invention are grown at a temperature in the range of about 20° C. to about 37° C. in an appropriate medium. Suitable growth media in the present invention are common commercially prepared media such as broth that includes yeast nitrogen base, ammonium sulfate, and dextrose as the carbon/energy source) or YPD Medium, a blend of peptone, yeast extract, and dextrose in optimal proportions for growing most Saccharomyces cerevisiae strains. Other defined or synthetic growth media can also be used and the appropriate medium for growth of the particular microorganism will be known by one skilled in the art of microbiology or fermentation science.

Suitable pH ranges for the fermentation can be between pH 3.0 to pH 7.5. A pH range of pH 4.5.0 to pH 6.5 can be used in an initial condition.

Fermentations can be performed under aerobic or anaerobic conditions, where anaerobic or microaerobic conditions are preferred.

The amount of butanol produced in the fermentation medium can be determined using a number of methods known in the art, for example, high performance liquid chromatography (HPLC) or gas chromatography (GC).

Industrial Batch and Continuous Fermentations

Methods of the present invention can employ a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, a "batch" fermentation is batch with respect to the addition of carbon source and attempts are often made at controlling factors such as pH and oxygen concentration. In batch systems, the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the media. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in Biotechnology: A Textbook of Industrial Microbiology, Second Edition (1989) Sinauer Associates, Inc., Sunderland, Mass., or Deshpande, Mukund V., Appl. Biochem. Biotechnol., 36:227, (1992), herein incorporated by reference.

Additionally, the methods of the present invention can be adaptable to continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention can be practiced using either batch, fed-batch or continuous processes and that any known mode of fermentation would be suitable. Additionally, it is contemplated that cells may be immobilized on a substrate as whole cell catalysts and subjected to fermentation conditions for butanol production.

Methods for Product Isolation from the Fermentation Medium

Products of the biosynthetic pathways of the invention (e.g., butanol) can be isolated from the fermentation medium using methods known in the art. For example, solids can be removed from the fermentation medium by extraction, centrifugation, filtration, decantation, or the like. Then, the product (e.g., butanol) can be isolated from the fermentation medium, which has been treated to remove solids as described above, using methods such as distillation, liquid-liquid extraction, or membrane-based separation. Because butanol forms a low boiling point, azeotropic mixture with water, distillation can only be used to separate the mixture up to its azeotropic composition. Distillation can be used in combination with another separation method to obtain separation around the azeotrope. Methods that can be used in combination with distillation to isolate and purify butanol include, but are not limited to, decantation, liquid-liquid extraction, adsorption, and membrane-based techniques. Additionally, butanol can be isolated using azeotropic distillation using an entrainer (see for example Doherty and Malone, *Conceptual Design of Distillation Systems*, McGraw Hill, New York, 2001).

The butanol-water mixture forms a heterogeneous azeotrope so that distillation can be used in combination with decantation to isolate and purify the butanol. In this method, the butanol containing fermentation broth is distilled to near the azeotropic composition. Then, the azeotropic mixture is condensed, and the butanol is separated from the fermentation medium by decantation. The decanted aqueous phase can be returned to the first distillation column as reflux. The butanol-rich decanted organic phase can be further purified by distillation in a second distillation column.

The products such as butanol can also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption can also be used to isolate butanol from a fermentation medium. In this method, the fermentation broth containing the butanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation can be used to isolate and purify a product such as butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245:199-210, 2004).

Methods for producing and recovering a product such as butanol from a fermentation broth using extractive fermentation are described in detail in U.S. patent application Ser. No. 12/478,389 filed on Jun. 4, 2009 and corresponding published U.S. Appn. Publ. No. 20090305370, U.S. Provisional Appl. No. 61/231,699 filed on Aug. 6, 2009, U.S. Provisional Appl. No. 61/368,429 filed on Jul. 28, 2010, and U.S. Appn. Publ. Nos. 20100221802 and 20110097773. Such methods include those which comprise the step of contacting the fermentation broth with a water immiscible organic extractant selected from the group consisting of $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty amides, $C_{12}$ to $C_{22}$ fatty aldehydes, and mixtures thereof, to form a two-phase mixture comprising an aqueous phase and a butanol-containing organic phase. "Contacting" means the fermentation medium and the organic extractant are brought into physical contact at any time during the fermentation process.

Examples of suitable extractants include, but are not limited to, an extractant comprising at least one solvent selected from the group consisting of oleyl alcohol, behenyl alcohol, cetyl alcohol, lauryl alcohol, myristyl alcohol, stearyl alcohol, oleic acid, lauric acid, myristic acid, stearic acid, methyl myristate, methyl oleate, lauric aldehyde, 1-nonanol, 1-decanol, 1-undecanol, 2-undecanol, 1-nonanal, and mixtures thereof. In one embodiment, the extractant comprises oleyl alcohol. These organic extractants are available commercially from various sources, such as Sigma-Aldrich (St. Louis, Mo.), in various grades, many of which are suitable for use in extractive fermentation to produce or recover butanol. Technical grades contain a mixture of compounds, including the desired component and higher and lower fatty components. For example, one commercially available technical grade oleyl alcohol contains about 65% oleyl alcohol and a mixture of higher and lower fatty alcohols.

In embodiments, the present invention is directed to a method of producing butanol, comprising (a) providing a recombinant host cell of the invention; and (b) contacting the host cell with a fermentable carbon substrate to form a fermentation broth under conditions whereby butanol is produced. In other embodiments, the method further comprises contacting the fermentation broth with an extractant to produce a two-phase fermentation mixture. In other embodiments, the extractant comprises fatty acids. In other embodiments, the fatty acids are derived from corn oil or soybean oil. In other embodiments, the extractant comprises a water immiscible organic extractant selected from the group consisting of: $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, $C_{12}$ to $C_{22}$ fatty amides. In other embodiments, the method further comprises contacting the fermentation broth with an organic acid and an enzyme capable of esterifying the butanol with the organic acid. In embodiments, the method further comprises vaporizing at least a portion of the fermentation broth to form a vapor stream comprising water and butanol.

Methods for measuring butanol titer and production are known. For example, butanol titer and production can be measured using gas chromatography (GC) or high performance liquid chromatography (HPLC) as described in the examples. In embodiments, the amount of butanol produced by a host cell of the invention is increased by at least about 10%, at least about 20%, at least about 30%, at least about 40%, at least about 50%, at least about 60%, at least about 70%, at least about 80%, at least about 90%, at least about 95%, at least about 2-fold, at least about 3-fold, or at least about 4-fold greater as compared to the amount of butanol produced by a host cell that does not comprise a polynucleotide encoding a polypeptide that catalyzes the conversion of pyruvate to acetolactate integrated into the chromosome. In embodiments, the titer of butanol produced by a host cell of the invention is increased by at least about 10%, at least about 20%, at least about 30%, at least about 40%, at least about 50%, at least about 60%, at least about 70%, at least about 80%, at least about 90%, at least about 95%, at least about 2-fold, at least about 3-fold, or at least about 4-fold greater as compared to a recombinant host cell wherein the polynucleotide encoding a polypeptide that catalyzes the conversion of pyruvate to acetolactate is not integrated into the chromosome.

In embodiments, the present invention is directed to a method for increasing the copy number or expression of a non-integrated recombinant polynucleotide encoding a polypeptide that catalyzes a step of a biosynthetic pathway described herein, comprising contacting a host cell of the invention with a fermentable carbon substrate to form a fermentation broth under conditions whereby the product of the biosynthetic pathway is produced, such as the fermentation conditions described herein. In other embodiments, the present invention is directed to a method for increasing the flux in a pyruvate-utilizing biosynthetic pathway, comprising contacting a host cell of the invention with a fermentable carbon substrate to form a fermentation broth under conditions whereby the flux in the pyruvate-utilizing biosynthetic pathway in the host cell is increased, such as the fermentation conditions described herein.

In other embodiments, the invention is directed to a method of increasing the formation of a product of a pyruvate-utilizing biosynthetic pathway comprising (i) providing a recombinant host cell of the invention; and (ii) growing the host cell under conditions wherein the product of the pyruvate-utilizing pathway is formed, wherein the amount of product formed by the recombinant host cell is greater than the amount of product formed by a host cell that does not comprise a polynucleotide encoding a polypeptide which catalyzes the conversion of pyruvate to acetolactate integrated into the chromosome. In other embodiments, the pyruvate-utilizing biosynthetic pathway forms 2,3-butanediol, isobutanol, 2-butanol or 2-butanone. In other embodiments, the pyruvate-utilizing biosynthetic pathway is a butanol biosynthetic pathway. In other embodiments, the butanol biosynthetic pathway is (a) a 2-butanol biosynthetic pathway; or (b) an isobutanol biosynthetic pathway.

In other embodiments, the invention is directed to a composition comprising (i) a host cell of the invention; (ii) butanol; and (iii) an extractant. In other embodiments, the invention is directed to a composition comprising (i) a host cell of the invention; (ii) butanol; (iii) an extractant; and (iv) an esterification enzyme. An esterification enzyme is one that catalyzes the reaction between and acid and an alcohol to generate an ester. In the broadest sense esterfication enzymes are hydrolases that act on an ester linkage and often referred to as esterases. As used herein lipases, are a subclass of esterases shown to be effective in forming esters between the fatty acids and isobutanol present in the broth. Such lipases may include one or more esterase enzymes, for example, hydrolase enzymes such as lipase enzymes. Lipase enzymes used may be derived from any source, including, for example, *Absidia, Achromobacter, Aeromonas, Alcaligenes, Alternaria, Aspergillus, Achromobacter, Aureobasidium, Bacillus, Beauveria, Brochothrix, Candida, Chromobacter, Coprinus, Fusarium, Geotricum, Hansenula, Humicola, Hyphozyma, Lactobacillus, Metarhizium, Mucor, Nectria, Neurospora, Paecilomyces, Penicillium, Pseudomonas, Rhizoctonia, Rhizomucor, Rhizopus, Rhodosporidium, Rhodotorula, Saccharomyces, Sus, Sporobolomyces, Thermomyces, Thiarosporella, Trichoderma, Verticillium*, and/or a strain of *Yarrowia*. In a preferred aspect, the source of the lipase is selected from the group consisting of *Absidia blakesleena, Absidia corymbifera, Achromobacter iophagus, Alcaligenes* sp., *Alternaria brassiciola, Aspergillus flavus, Aspergillus niger, Aureobasidium pullulans, Bacillus pumilus, Bacillus strearothermophilus, Bacillus subtilis, Brochothrix thermosohata, Candida cylindracea (Candida rugosa), Candida paralipolytica, Candida Antarctica* lipase A, *Candida antartica* lipase B, *Candida ernobii, Candida deformans, Chromobacter viscosum, Coprinus cinerius, Fusarium oxysporum, Fusarium solani, Fusarium solani pisi, Fusarium roseum culmorum, Geotricum penicillatum, Hansenula anomala, Humicola brevispora, Humicola brevis* var. thermoidea, *Humicola insolens, Lactobacillus curvatus, Rhizopus oryzae, Penicillium cyclopium, Penicillium crustosum, Penicillium expansum, Penicillium* sp. I, *Penicillium* sp. II, *Pseudomonas aeruginosa, Pseudomonas alcaligenes, Pseudomonas cepacia* (syn. *Burkholderia cepacia*), *Pseudomonas fluorescens, Pseudomonas fragi, Pseudomonas maltophilia, Pseudomonas mendocina, Pseudomonas mephitica lipolytica, Pseudomonas alcaligenes, Pseudomonas plantari, Pseudomonas pseudoalcaligenes, Pseudomonas putida, Pseudomonas stutzeri*, and *Pseudomonas wisconsinensis, Rhizoctonia solani, Rhizomucor miehei, Rhizopus japonicus, Rhizopus microsporus, Rhizopus nodosus, Rhodosporidium toruloides, Rhodotorula glutinis, Saccharomyces cerevisiae, Sporobolomyces shibatanus, Sus scrofa, Thermomyces lanuginosus* (formerly *Humicola lanuginose*), *Thiarosporella phaseolina, Trichoderma harzianum, Trichoderma reesei*, and *Yarrowia lipolytica*. In a further preferred aspect, the lipase is selected from the group consisting of *Thermomcyces lanuginosus, Aspergillus* sp. lipase, *Aspergillus niger* lipase, *Candida antartica* lipase B, *Pseudomonas* sp. lipase, *Penicillium roqueforti* lipase, *Penicillium camembertii* lipase, *Mucor javanicus* lipase, *Burkholderia cepacia* lipase, *Alcaligenes* sp. lipase, *Candida rugosa* lipase, *Candida parapsilosis* lipase, *Candida deformans* lipase, lipases A and B from *Geotrichum candidum, Neurospora crassa* lipase, *Nectria haematococca* lipase, *Fusarium heterosporum* lipase *Rhizopus delemar* lipase, *Rhizomucor miehei* lipase, *Rhizopus arrhizus* lipase, and *Rhizopus oryzae* lipase. Suitable commercial lipase preparations suitable as enzyme catalyst 42 include, but are not limited to Lipolase® 100 L, Lipex® 100L, Lipoclean® 2000T, Lipozyme® CALB L, Novozym® CALA L, and Palatase 20000L, available from Novozymes, or from *Pseudomonas fluorescens, Pseudomonas cepacia, Mucor miehei*, hog pancreas, *Candida cylindracea, Rhizopus niveus, Candida antarctica, Rhizopus arrhizus* or *Aspergillus* available from SigmaAldrich.

In embodiments, the extractant comprises fatty acids. In embodiments, the fatty acids are derived from corn oil or soybean oil. In other embodiments, the extractant is a water immiscible organic extractant. In other embodiments, the extractant is $C_{12}$ to $C_{22}$ fatty alcohols, $C_{12}$ to $C_{22}$ fatty acids, esters of $C_{12}$ to $C_{22}$ fatty acids, or $C_{12}$ to $C_{22}$ fatty aldehydes.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook et al., *Molecular Cloning: A Laboratory Manual*; Cold Spring Harbor Laboratory Press: Cold Spring Harbor, N.Y. (1989) (Maniatis), Silhavy et al., *Experiments with Gene Fusions*, Cold Spring Harbor Laboratory Press, Cold Spring Harbor, N.Y. (1984), Ausubel et al., *Current Protocols in Molecular Biology*, pub. by Greene Publishing Assoc. and Wiley-Interscience (1987), and by *Methods in Yeast Genetics,* 2005, Cold Spring Harbor Laboratory Press, Cold Spring Harbor, N.Y.

Materials and methods suitable for the maintenance and growth of bacterial cultures are well known in the art. Techniques suitable for use in the following Examples may be found as set out in *Manual of Methods for General Bacteriology* (Phillipp Gerhardt et al., eds, American Society for Microbiology, Washington, D.C., 1994) or by Thomas D. Brock in *Biotechnology: A Textbook of Industrial Microbiology* (Second Edition, Sinauer Associates, Inc., Sunderland, Mass., 1989). All reagents, restriction enzymes and materials used for the growth and maintenance of microbial cells were obtained from Aldrich Chemicals (Milwaukee, Wis.), BD Diagnostic Systems (Sparks, Md.), Life Technologies (Rockville, Md.), New England Biolabs (Ipswich, Mass.) or Sigma Chemical Company (St. Louis, Mo.) unless otherwise specified. Microbial strains were obtained from The American Type Culture Collection (ATCC), Manassas, Va., unless otherwise noted. All the oligonucleotide primers were synthesized by Sigma-Genosys (Woodlands, Tex.) or Integrated DNA Technologies (Coralsville, Iowa). Synthetic complete medium is described in Amberg, Burke and Strathern, 2005, Methods in Yeast Genetics, Cold Spring Harbor Laboratory Press, Cold Spring Harbor, N.Y.

GC

The GC method utilized an HP-InnoWax column (30 m×0.32 mm ID, 0.25 µm film) from Agilent Technologies (Santa Clara, Calif.). The carrier gas was helium at a flow rate of 1 ml/min measured at 150° C. with constant head pressure; injector split was 1:10 at 200° C.; oven temperature was 45° C. for 1 min, 45° C. to 230° C. at 10° C./min, and 230° C. for 30 sec. FID detection was used at 260° C. with 40 ml/min helium makeup gas. Culture broth samples were filtered through 0.2 µM spin filters before injection. Depending on analytical sensitivity desired, either 0.1 µl or 0.5 µl injection volumes were used. Calibrated standard curves were generated for the following compounds: ethanol, isobutanol, acetoin, meso-2,3-butanediol, and (2S,3S)-2,3-butanediol. Analytical standards were also utilized to identify retention times for isobutryaldehyde, isobutyric acid, and isoamyl alcohol.

HPLC

Analysis for fermentation by-product composition is well known to those skilled in the art. For example, one high performance liquid chromatography (HPLC) method utilizes a Shodex SH-1011 column with a Shodex SH-G guard column (both available from Waters Corporation, Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol retention time is 47.6 minutes.

Methods for Determining Isobutanol Concentration in Culture Media

The concentration of isobutanol in the culture media can be determined by a number of methods known in the art. For example, a specific high performance liquid chromatography (HPLC) method utilized a Shodex SH-1011 column with a Shodex SH-G guard column, both purchased from Waters Corporation (Milford, Mass.), with refractive index (RI) detection. Chromatographic separation was achieved using 0.01 M $H_2SO_4$ as the mobile phase with a flow rate of 0.5 mL/min and a column temperature of 50° C. Isobutanol had a retention time of 46.6 min under the conditions used. Alternatively, gas chromatography (GC) methods are available. For example, a specific GC method utilized an HP-INNOWax column (30 m×0.53 mm id, 1 µm film thickness, Agilent Technologies, Wilmington, Del.), with a flame ionization detector (FID). The carrier gas was helium at a flow rate of 4.5 mL/min, measured at 150° C. with constant head pressure; injector split was 1:25 at 200° C.; oven temperature was 45° C. for 1 min, 45 to 220° C. at 10° C./min, and 220° C. for 5 min; and FID detection was employed at 240° C. with 26 mL/min helium makeup gas. The retention time of isobutanol was 4.5 min.

The meaning of abbreviations is as follows: "s" means second(s), "min" means minute(s), "h" means hour(s), "psi" means pounds per square inch, "nm" means nanometers, "d" means day(s), "µL" means microliter(s), "mL" means milliliter(s), "L" means liter(s), "mm" means millimeter(s), "nm" means nanometers, "mM" means millimolar, "M" means molar, "mmol" means millimole(s), "µmol" means micromole(s), "g" means gram(s), "µg" means microgram(s) and "ng" means nanogram(s), "PCR" means polymerase chain reaction, "OD" means optical density, "$OD_{600}$" means the optical density measured at a wavelength of 600 nm, "kDa" means kilodaltons, "g" means the gravitation constant, "bp" means base pair(s), "kbp" means kilobase pair(s), "% w/v" means weight/volume percent, "% v/v" means volume/volume percent, "wt %" means percent by weight, "HPLC" means high performance liquid chromatography, and "GC" means gas chromatography. The term "molar selectivity" is the number of moles of product produced per mole of sugar substrate consumed and is reported as a percent.

Example 1

Construction of *Saccharomyces cerevisiae* Strain BP1083 ("NGCI-070"; PNY1504)

The strain BP1064 was derived from CEN.PK 113-7D (CBS 8340; Centraalbureau voor Schimmelcultures (CBS) Fungal Biodiversity Centre, Netherlands) and contains deletions of the following genes: URA3, HIS3, PDC1, PDC5, PDC6, and GPD2. BP1064 was transformed with plasmids pYZ090 (SEQ ID NO:134) and pLH468 (SEQ ID NO:135) to create strain NGCI-070 (BP1083, PNY1504).

Deletions, which completely removed the entire coding sequence, were created by homologous recombination with PCR fragments containing regions of homology upstream and downstream of the target gene and either a G418 resistance marker or URA3 gene for selection of transformants. The G418 resistance marker, flanked by loxP sites, was removed using Cre recombinase. The URA3 gene was removed by homologous recombination to create a scarless deletion, or if flanked by loxP sites was removed using Cre recombinase.

The scarless deletion procedure was adapted from Akada et al., Yeast, 23:399, 2006. In general, the PCR cassette for each scarless deletion was made by combining four fragments, A-B-U-C, by overlapping PCR. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene). Fragments A and C, each 500 bp long, corresponded to the 500 bp immediately upstream of the target gene (Fragment A) and the 3' 500 bp of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome. Using the PCR product ABUC cassette, the URA3 marker was first integrated into and then excised from the chromosome by homologous recombination. The initial integration deleted the gene, excluding the 3' 500 bp. Upon excision, the 3' 500 bp region of the gene was also deleted. For integration of genes using this method, the gene to be integrated was included in the PCR cassette between fragments A and B.

URA3 Deletion

To delete the endogenous URA3 coding region, a ura3::loxP-kanMX-loxP cassette was PCR-amplified from pLA54 template DNA (SEQ ID NO:136). pLA54 contains the *K. lactis* TEF1 promoter and kanMX marker, and is flanked by loxP sites to allow recombination with Cre recombinase and removal of the marker. PCR was done using Phusion DNA polymerase and primers BK505 and BK506 (SEQ ID NOs: 137 and 138). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G418 (100 μg/ml) at 30° C. Transformants were screened to verify correct integration by PCR using primers LA468 and LA492 (SEQ ID NOs:139 and 140) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO:141) and primer oBP453 (SEQ ID NO:142), containing a 5' tail with homology to the 5' end of HIS3 Fragment B. HIS3 Fragment B was amplified with primer oBP454 (SEQ ID NO:143), containing a 5' tail with homology to the 3' end of HIS3 Fragment A, and primer oBP455 (SEQ ID NO:144), containing a 5' tail with homology to the 5' end of HIS3 Fragment U. HIS3 Fragment U was amplified with primer oBP456 (SEQ ID NO:145), containing a 5' tail with homology to the 3' end of HIS3 Fragment B, and primer oBP457 (SEQ ID NO:146), containing a 5' tail with homology to the 5' end of HIS3 Fragment C. HIS3 Fragment C was amplified with primer oBP458 (SEQ ID NO:147), containing a 5' tail with homology to the 3' end of HIS3 Fragment U, and primer oBP459 (SEQ ID NO:148). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO:141) and oBP455 (SEQ ID NO:144). HIS3 Fragment UC was created by overlapping PCR by mixing HIS3 Fragment U and HIS3 Fragment C and amplifying with primers oBP456 (SEQ ID NO:145) and oBP459 (SEQ ID NO:148). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO:141) and oBP459 (SEQ ID NO:148). The PCR product was purified with a PCR Purification kit (Qiagen).

Competent cells of CEN.PK 113-7D Δura3::kanMX were made and transformed with the HIS3 ABUC PCR cassette using a Frozen-EZ Yeast Transformation II kit (Zymo Research; Orange, Calif.). Transformation mixtures were plated on synthetic complete media lacking uracil supplemented with 2% glucose at 30° C. Transformants with a his3 knockout were screened for by PCR with primers oBP460 (SEQ ID NO:149) and oBP461 (SEQ ID NO:150) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the Δura3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 66, described in U.S. Provisional Appl. No. 61/290,639) using a Frozen-EZ Yeast Transformation II kit (Zymo Research) and plating on synthetic complete medium lacking histidine and uracil supplemented with 2% glucose at 30° C. Transformants were grown in YP supplemented with 1% galactose at 30° C. for ~6 hours to induce the Cre recombinase and KanMX marker excision and plated onto YPD (2% glucose) plates at 30° C. for recovery. An isolate was grown overnight in YPD and plated on synthetic complete medium containing 5-fluoro-orotic acid (0.1%) at 30° C. to select for isolates that lost the URA3 marker. 5-FOA resistant isolates were grown in and plated on YPD for removal of the pRS423::PGAL1-cre plasmid. Isolates were checked for loss of the KanMX marker, URA3 marker, and pRS423::PGAL1-cre plasmid by assaying growth on YPD+G418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO:151) and oBP451 (SEQ ID NO:152) for Δura3 and primers oBP460 (SEQ ID NO:149) and oBP461 (SEQ ID NO:150) for Δhis3 using genomic DNA prepared with a Gentra Puregene Yeast/Bact kit (Qiagen).

PDC6 Deletion

The four fragments for the PCR cassette for the scarless PDC6 deletion were amplified using Phusion High Fidelity PCR Master Mix (New England BioLabs) and CEN.PK 113-7D genomic DNA as template, prepared with a Gentra Puregene Yeast/Bact kit (Qiagen). PDC6 Fragment A was amplified with primer oBP440 (SEQ ID NO:153) and primer oBP441 (SEQ ID NO:154), containing a 5' tail with homology to the 5' end of PDC6 Fragment B. PDC6 Fragment B was amplified with primer oBP442 (SEQ ID NO:155), containing a 5' tail with homology to the 3" end of PDC6 Fragment A, and primer oBP443 (SEQ ID NO:156), containing a 5' tail with homology to the 5' end of PDC6 Fragment U. PDC6 Fragment U was amplified with primer oBP444 (SEQ ID NO:157), containing a 5' tail with homology to the 3' end of PDC6 Fragment B, and primer oBP445 (SEQ ID NO:158), containing a 5' tail with homology to the 5' end of PDC6 Fragment C. PDC6 Fragment C was amplified with primer oBP446 (SEQ ID NO:159), containing a 5' tail with homology to the 3' end of PDC6 Fragment U, and primer oBP447 (SEQ ID NO:160). PCR products were purified with a PCR Purification kit (Qiagen). PDC6 Fragment AB was created by overlapping PCR by mixing PDC6 Fragment A and PDC6 Fragment B and amplifying with primers oBP440 (SEQ ID NO:153) and oBP443 (SEQ ID NO:156). PDC6 Fragment UC was created by overlapping PCR by mixing PDC6 Fragment U and PDC6 Fragment C and amplifying with primers oBP444 (SEQ ID NO:157) and oBP447 (SEQ ID NO:160). The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO:153) and oBP447 (SEQ ID NO:160). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30° C. Transformants with a pdc6 knockout were screened for by PCR with primers oBP448 (SEQ ID NO:161) and oBP449 (SEQ ID NO:162) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO:161) and oBP449 (SEQ ID NO:162) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO:163) and oBP555 (SEQ ID NO:164). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from *Streptococcus mutans* ATCC #700610. The A fragment followed by the ilvD coding region from *Streptococcus mutans* for the PCR cassette for the PDC1 deletion-ilvDSm integration was amplified using Phusion High Fidelity PCR Master Mix (New England BioLabs) and NYLA83 (described in U.S. Provisional Appl. No. 61/246, 709) genomic DNA as template, prepared with a Gentra Puregene Yeast/Bact kit (Qiagen). PDC1 Fragment A-ilvDSm (SEQ ID NO:165) was amplified with primer oBP513 (SEQ ID NO:166) and primer oBP515 (SEQ ID NO:167), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO:168) containing a 5' tail with homology to the 3' end of PDC1 Fragment A-ilvDSm, and primer oBP517 (SEQ ID NO:169), containing a 5' tail with homology to the 5' end of PDC1 Fragment U. PDC1 Fragment U was amplified with primer oBP518 (SEQ ID NO:170), containing a 5' tail with homology to the 3' end of PDC1 Fragment B, and primer oBP519 (SEQ ID NO:171), containing a 5' tail with homology to the 5' end of PDC1 Fragment C. PDC1 Fragment C was amplified with primer oBP520 (SEQ ID NO:172), containing a 5' tail with homology to the 3' end of PDC1 Fragment U, and primer oBP521 (SEQ ID NO:173). PCR products were purified with a PCR Purification kit (Qiagen). PDC1 Fragment A-ilvDSm-B was created by overlapping PCR by mixing PDC1 Fragment A-ilvDSm and PDC1 Fragment B and amplifying with primers oBP513 (SEQ ID NO:166) and oBP517 (SEQ ID NO:169). PDC1 Fragment UC was created by overlapping PCR by mixing PDC1 Fragment U and PDC1 Fragment C and amplifying with primers oBP518 (SEQ ID NO:170) and oBP521 (SEQ ID NO:173). The resulting PCR products were purified on an agarose gel followed by a Gel Extraction kit (Qiagen). The PDC1 A-ilvDSm-BUC cassette (SEQ ID NO:174) was created by overlapping PCR by mixing PDC1 Fragment A-ilvDSm-B and PDC1 Fragment UC and amplifying with primers oBP513 (SEQ ID NO:166) and oBP521 (SEQ ID NO:173). The PCR product was purified with a PCR Purification kit (Qiagen).

Competent cells of CEN.PK 113-7D Δura3::loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30 C. Transformants with a pdc1 knockout ilvDSm integration were screened for by PCR with primers oBP511 (SEQ ID NO:175) and oBP512 (SEQ ID NO:176) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO:177) and oBP551 (SEQ ID NO:178). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30° C. to select for isolates that lost the URA3 marker. The deletion of PDC1, integration of ilvDSm, and marker removal were confirmed by PCR and sequencing with primers oBP511 (SEQ ID NO:175) and oBP512 (SEQ ID NO:176) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm and designated as BP907.

PDC5 Deletion sadB Integration

The PDC5 gene was deleted and replaced with the sadB coding region from *Achromobacter xylosoxidans*. A segment of the PCR cassette for the PDC5 deletion-sadB integration was first cloned into plasmid pUC19-URA3MCS.

pUC19-URA3MCS is pUC19 based and contains the sequence of the URA3 gene from *Saccharomyces cerevisiae* situated within a multiple cloning site (MCS). pUC19 contains the pMB1 replicon and a gene coding for beta-lactamase for replication and selection in *Escherichia coli*. In addition to the coding sequence for URA3, the sequences from upstream and downstream of this gene were included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccharomyces cerevisiae* CEN.PK 113-7D genomic DNA was amplified with primers oBP438 (SEQ ID NO:179), containing BamHI, AscI, PmeI, and FseI restriction sites, and oBP439 (SEQ ID NO:180), containing XbaI, PacI, and NotI restriction sites, using Phusion High-Fidelity PCR Master Mix (New England BioLabs). Genomic DNA was prepared using a Gentra Puregene Yeast/Bact kit (Qiagen). The PCR product and pUC19 (SEQ ID NO:181) were ligated with T4 DNA ligase after digestion with BamHI and XbaI to create vector pUC19-URA3MCS. The vector was confirmed by PCR and sequencing with primers oBP264 (SEQ ID NO:182) and oBP265 (SEQ ID NO:183).

The coding sequence of sadB and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO:184) as template with primer oBP530 (SEQ ID NO:185), containing an AscI restriction site, and primer oBP531 (SEQ ID NO:186), containing a 5' tail with homology to the 5' end of PDC5 Fragment B. PDC5 Fragment B was amplified with primer oBP532 (SEQ ID NO:187), containing a 5' tail with homology to the 3' end of sadB, and primer oBP533 (SEQ ID NO:188), containing a PmeI restriction site. PCR products were purified with a PCR Purification kit (Qiagen). sadB-PDC5 Fragment B was created by overlapping PCR by mixing the sadB and PDC5 Fragment B PCR products and amplifying with primers oBP530 (SEQ ID NO:185) and oBP533 (SEQ ID NO:188). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO:189) and oBP546 (SEQ ID NO:190), containing a 5' tail with homology to the 5' end of PDC5 Fragment C. PDC5 Fragment C was amplified with primer oBP547 (SEQ ID NO:191) containing a 5' tail with homology to the 3' end of PDC5 sadB-Fragment B-Fragment U, and primer oBP539 (SEQ ID NO:192). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO:189) and oBP539 (SEQ ID NO:192). The resulting PCR product was purified on an agarose gel followed by a Gel Extraction kit (Qiagen). The PDC5 A-sadB-BUC cassette (SEQ ID NO:193) was created by amplifying PDC5 sadB-Fragment B-Fragment U-Fragment C with primers oBP542 (SEQ ID NO:194), containing a 5' tail with homology to the 50 nucleotides immediately upstream of the native PDC5 coding sequence, and oBP539 (SEQ ID NO:192). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30 C. Transformants with a pdc5 knockout sadB integration were screened for by PCR with primers oBP540 (SEQ ID NO:195) and oBP541 (SEQ ID NO:196) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO:197) and oBP553 (SEQ ID NO:198). A correct transformant was selected as strain CEN.PK 113-7D Δura3::loxP Δhis3 Δpdc6 Δpdc1::ilvDSm Δpdc5::sadB-URA3.

CEN.PK 113-7D Δura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30 C to select for isolates that lost the URA3 marker. The deletion of PDC5, integration of sadB, and marker removal were confirmed by PCR with primers oBP540 (SEQ ID NO:195) and oBP541 (SEQ ID NO:196) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

GPD2 Deletion

To delete the endogenous GPD2 coding region, a gpd2::loxP-URA3-loxP cassette (SEQ ID NO:131) was PCR-amplified using loxP-URA3-loxP PCR (SEQ ID NO:200) as template DNA. loxP-URA3-loxP contains the URA3 marker from (ATCC #77107) flanked by loxP recombinase sites. PCR was done using Phusion DNA polymerase and primers LA512 and LA513 (SEQ ID NOs:201 and 202). The GPD2 portion of each primer was derived from the 5' region upstream of the GPD2 coding region and 3' region downstream of the coding region such that integration of the loxP-URA3-loxP marker resulted in replacement of the GPD2 coding region. The PCR product was transformed into BP913 and transformants were selected on synthetic complete media lacking uracil supplemented with 1% ethanol (no glucose). Transformants were screened to verify correct integration by PCR using primers oBP582 and AA270 (SEQ ID NOs:198 and 203).

The URA3 marker was recycled by transformation with pRS423::PGAL1-cre (SEQ ID NO:204) and plating on synthetic complete media lacking histidine supplemented with 1% ethanol at 30 C. Transformants were streaked on synthetic complete medium supplemented with 1% ethanol and containing 5-fluoro-orotic acid (0.1%) and incubated at 30 C to select for isolates that lost the URA3 marker. 5-FOA resistant isolates were grown in YPE (1% ethanol) for removal of the pRS423::PGAL1-cre plasmid. The deletion and marker removal were confirmed by PCR with primers oBP582 (SEQ ID NO:198) and oBP591 (SEQ ID NO:205). The correct isolate was selected as strain CEN.PK 113-7D Δura3::loxP Δhis3 Δpdc6 Δpdc1::ilvDSm Δpdc5::sadB Δgpd2::loxP and designated as BP1064 (PNY1503).

BP1064 was transformed with plasmids pYZ090 (SEQ ID NO:134) and pLH468 (SEQ ID NO:135) to create strain NGCI-070 (BP1083; PNY1504).

pYZ090 is based on the pHR81 (ATCC #87541, Manassas, Va.) backbone and was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI. The pLH468 plasmid (SEQ ID NO:2) was constructed for expression of DHAD, KivD and HADH in yeast and is described in U.S. Application Publication No. 20090305363, herein incorporated by reference.

Example 2

Construction of *Saccharomyces cerevisiae* Strains BP1135 and PNY1507 and Isobutanol-Producing Derivatives The purpose of this Example was to construct *Saccharomyces cerevisiae* strains BP1135 and PNY1507. These strains were derived from PNY1503 (BP1064). PNY1503 was derived from CEN.PK 113-7D (CBS 8340; Centraalbureau voor Schimmelcultures (CBS) Fungal Biodiversity Centre, Netherlands). The construction of PNY1503 (BP1064) is described above. BP1135 contains an additional deletion of the FRA2 gene. PNY1507 was derived from BP1135 with additional deletion of the ADH1 gene, with integration of the kivD gene from *Lactococcus lactis*, codon optimized for expression in *Saccharomyces cerevisiae*, into the ADH1 locus.

Deletions, which generally removed the entire coding sequence, were created by homologous recombination with PCR fragments containing regions of homology upstream and downstream of the target gene and the URA3 gene for selection of transformants. The URA3 gene was removed by homologous recombination to create a scarless deletion. Gene integrations were generated in a similar manner.

The scarless deletion procedure was adapted from Akada et al., *Yeast*, 23:399, 2006. In general, the PCR cassette for each scarless deletion was made by combining four fragments, A-B-U-C, by overlapping PCR. In some instances, the individual fragments were first cloned into a plasmid prior to the entire cassette being amplified by PCR for the deletion/integration procedure. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C, each generally 500 bp long, corresponded to the 500 bp immediately upstream of the target gene (Fragment A) and the 3' 500 bp of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome.

Using the PCR product ABUC cassette, the URA3 marker was first integrated into and then excised from the chromosome by homologous recombination. The initial integration deleted the gene, excluding the 3' 500 bp. Upon excision, the 3' 500 bp region of the gene was also deleted. For integration of genes using this method, the gene to be integrated was included in the PCR cassette between fragments A and B.

FRA2 Deletion

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). FRA2 Fragment A was amplified with primer oBP594 (SEQ ID NO:99) and primer oBP595 (SEQ ID NO:100), containing a 5' tail with homology to the 5' end of FRA2 Fragment B. FRA2 Fragment B was amplified with primer oBP596 (SEQ ID NO:101), containing a 5' tail with homology to the 3' end of FRA2 Fragment A, and primer oBP597 (SEQ ID NO:102), containing a 5' tail with homology to the 5' end of FRA2 Fragment U. FRA2 Fragment U was amplified with primer oBP598 (SEQ ID NO:103), containing a 5' tail with homology to the 3' end of FRA2 Fragment B, and primer oBP599 (SEQ ID NO:104), containing a 5' tail with homology to the 5' end of FRA2 Fragment C. FRA2 Fragment C was amplified with primer oBP600 (SEQ ID NO:105), containing a 5' tail with homology to the 3' end of FRA2 Fragment U, and primer oBP601 (SEQ ID NO:106). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO:99) and oBP597 (SEQ ID NO:102). FRA2 Fragment UC was created by overlapping PCR by mixing FRA2 Fragment U and FRA2 Fragment C and amplifying with primers oBP598 (SEQ ID NO:103) and oBP601 (SEQ ID NO:106). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO:99 and oBP601 (SEQ ID NO:106). The PCR product was purified with a PCR Purification kit (Qiagen).

Competent cells of PNY1503 were made and transformed with the FRA2 ABUC PCR cassette using a Frozen-EZ Yeast Transformation II kit (Zymo Research; Orange, Calif.). Transformation mixtures were plated on synthetic complete media lacking uracil supplemented with 1% ethanol at 30° C. Transformants with a fra2 knockout were screened for by PCR with primers oBP602 (SEQ ID NO:107) and oBP603 (SEQ ID NO:108) using genomic DNA prepared with a Gentra Puregene Yeast/Bact kit (Qiagen). A correct transformant was grown in YPE (yeast extract, peptone, 1% ethanol) and plated on synthetic complete medium containing 5-fluoro-orotic acid (0.1%) at 30° C. to select for isolates that lost the URA3 marker. The deletion and marker removal were confirmed by PCR with primers oBP602 (SEQ ID NO:107) and oBP603 (SEQ ID NO:108) using genomic DNA prepared with a Gentra Puregene Yeast/Bact kit (Qiagen). The absence of the FRA2 gene from the isolate was demonstrated by a negative PCR result using primers specific for the deleted coding sequence of FRA2, oBP605 (SEQ ID NO:109) and oBP606 (SEQ ID NO:110). The correct isolate was selected as strain CEN.PK 113-7D MATa ura3Δ::loxP his3Δ pdc6Δ pdc1Δ::P[PDC1]-DHAD|ilvD_Sm-PDC1t pdc5Δ::P[PDC5]-ADH|sadB_Ax-PDC5t gpd2Δ::loxP fra2Δ and designated as PNY1505 (BP1135). This strain was transformed with isobutanol pathway plasmids (pYZ090, SEQ ID NO:134) and pLH468 (U.S. Provisional Appl. No. 61/246,709, filed Sep. 29, 2009), and one clone was designated BP1168 (PNY1506).

ADH1 Deletion and kivD_Ll(y) Integration

The ADH1 gene was deleted and replaced with the kivD coding region from *Lactococcus lactis* codon optimized for expression in *Saccharomyces cerevisiae*. The scarless cassette for the ADH1 deletion-kivD_Ll(y) integration was first cloned into plasmid pUC19-URA3MCS, as described in U.S. Appln. No. 61/356,379, filed Jun. 18, 2010, incorporated herein by reference.

The kivD coding region from *Lactococcus lactis* codon optimized for expression in *Saccharomyces cerevisiae* was amplified using pLH468 (U.S. Provisional Appl. No. 61/246,709, filed Sep. 29, 2009) as template with primer oBP562 (SEQ ID NO:111), containing a PmeI restriction site, and primer oBP563 (SEQ ID NO:112), containing a 5' tail with homology to the 5' end of ADH1 Fragment B. ADH1 Fragment B was amplified from genomic DNA prepared as above with primer oBP564 (SEQ ID NO:113), containing a 5' tail with homology to the 3' end of kivD_Ll(y), and primer oBP565 (SEQ ID NO:114), containing a FseI restriction site. PCR products were purified with a PCR Purification kit (Qiagen). kivD_Ll(y)-ADH1 Fragment B was created by overlapping PCR by mixing the kivD_Ll(y) and ADH1 Fragment B PCR products and amplifying with primers oBP562 (SEQ ID NO:111) and oBP565 (SEQ ID NO:114). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO:115), containing a SacI restriction site, and primer oBP506 (SEQ ID NO:116), containing an AscI restriction site. The ADH1 Fragment A PCR product was digested with SacI and AscI and ligated with T4 DNA ligase into the corresponding sites of the plasmid containing kivD_Ll(y)-ADH1 Fragment B. ADH1 Fragment C was amplified from genomic DNA with primer oBP507 (SEQ ID NO:117), containing a PacI restriction site, and primer oBP508 (SEQ ID NO:118), containing a SalI restriction site. The ADH1 Fragment C PCR product was digested with PacI and SalI and ligated with T4 DNA ligase into the corresponding sites of the plasmid containing ADH1 Fragment A-kivD_Ll(y)-ADH1 Fragment B. The hybrid promoter UAS(PGK1)-P$_{FBA1}$ was amplified from vector pRS316-UAS(PGK1)-P$_{FBA1}$-GUS (described below; SEQ ID NO:206) with primer oBP674 (SEQ ID NO:119), containing an AscI restriction site, and primer oBP675 (SEQ ID NO:120), containing a PmeI restriction site. The UAS (PGK1)-P$_{FBA1}$ PCR product was digested with AscI and PmeI and ligated with T4 DNA ligase into the corresponding sites of the plasmid containing kivD_Ll(y)-ADH1 Fragments ABC. The entire integration cassette was amplified from the resulting plasmid with primers oBP505 (SEQ ID NO:115) and oBP508 (SEQ ID NO:118) and purified with a PCR Purification kit (Qiagen).

Competent cells of PNY1505 were made and transformed with the ADH1-kivD_Ll(y) PCR cassette constructed above using a Frozen-EZ Yeast Transformation II kit (Zymo Research). Transformation mixtures were plated on synthetic complete media lacking uracil supplemented with 1% ethanol at 30° C. Transformants were grown in YPE (1% ethanol) and plated on synthetic complete medium containing 5-fluoroorotic acid (0.1%) at 30° C. to select for isolates that lost the URA3 marker. The deletion of ADH1 and integration of kivD_Ll(y) were confirmed by PCR with external primers oBP495 (SEQ ID NO:121) and oBP496 (SEQ ID NO:122) and with kivD_Ll(y) specific primer oBP562 (SEQ ID NO:111) and external primer oBP496 (SEQ ID NO:122) using genomic DNA prepared with a Gentra Puregene Yeast/Bact kit (Qiagen). The correct isolate was selected as strain CEN.PK 113-7D MATa ura3Δ::loxP his3Δ pdc6Δ. pdc1Δ::P [PDC1]-DHAD|ilvD_Sm-PDC1tpdc5Δ::P [PDC5]-ADH|sadB_Ax-PDC5t gpd2Δ::loxP fra2Δ adh1Δ:UAS (PGK1)P[FBA1]-kivD_Ll(y)-ADH1t and designated as PNY1507 (BP1201). PNY1507 was transformed with isobutanol pathway plasmids pYZ090 (SEQ ID NO:134) and pBP915 (described below). Isobutanol production by these derivatives is described below.

Construction of the pRS316-UAS(PGK1)-FBA1p-GUS Vector

To clone a cassette UAS(PGK1)-FBA1p (SEQ ID NO:129), first a 602 bp FBA1 promoter (FBA1p) was PCR-amplified from genomic DNA of CEN.PK with primers T-FBA1 (SalI) (SEQ ID NO:123) and B-FBA1 (SpeI) (SEQ ID NO:124), and cloned into SalI and SpeI sites on the plasmid pWS358-PGK1p-GUS (SEQ ID NO:130) after the PGK1p promoter was removed with a SalI/SpeI digest of the plasmid, yielding pWS358-FBA1p-GUS. The pWS358-PGK1p-GUS plasmid was generated by inserting a PGK1p and beta-glucuronidase gene (GUS) DNA fragments into multiple cloning site of pWS358, which was derived from pRS423 vector (Christianson et al., *Gene,* 110:119-122, 1992). Secondly, the resulting pWS358-FBA1p-GUS plasmid was digested with SalI and SacI, a DNA fragment containing a FBA1p promoter, GUS gene, and FBAt terminator gel-purified, and cloned into SalI/SacI sites on pRS316 to create pRS316-FBA1p-GUS. Thirdly, a 118 bp DNA fragment containing an upstream activation sequence (UAS) located between positions −519 and −402 upstream of the 3-phosphoglycerate kinase (PGK1) open reading frame, namely UAS(PGK1), was PCR-amplified from genomic DNA of CEN.PK with primers T-U/PGK1 (KpnI) (SEQ ID NO:125) and B-U/PGK1 (SalI) (SEQ ID NO:126). The PCR product was digested with KpnI and SalI and cloned into KpnI/SalI sites on pRS316-FBA1p-GUS to create pRS316-UAS(PGK1)-FBA1p-GUS.

Example 3

Construction of PNY2204 and Isobutanol-Producing Derivatives

The purpose of this example is to describe construction of a vector to enable integration of a gene encoding acetolactate synthase into the naturally occurring intergenic region between the PDC1 and TRX1 coding sequences in Chromosome XII.

Construction of Integration Vector pUC19-kan::pdc1::FBA-alsS::TRX1

The FBA-alsS-CYCt cassette was constructed by moving the 1.7 kb BbvCI/PacI fragment from pRS426::GPD::alsS::CYC (U.S. Appl. Pub. No. 20070092957) to pRS426::FBA::ILV5::CYC (U.S. Appl. Pub. No. 20070092957, previously digested with BbvCI/PacI to release the ILV5 gene). Ligation reactions were transformed into *E. coli* TOP10 cells and transformants were screened by PCR using primers N98SeqF1 (SEQ ID NO:91) and N99SeqR2 (SEQ ID NO:93). The FBA-alsS-CYCt cassette was isolated from the vector using BglII and NotI for cloning into pUC19-URA3::ilvD-TRX1 (as described in U.S. Appln. No. 61/356,379, filed Jun. 18, 2010, incorporated herein by reference, clone "B"; herein SEQ ID NO: 243) at the AflII site (Klenow fragment was used to make ends compatible for ligation). Transformants containing the alsS cassette in both orientations in the vector were obtained and confirmed by PCR using primers N98SeqF4 (SEQ ID NO:92) and N1111 (SEQ ID NO:97) for configuration "A" and N98SeqF4 (SEQ ID NO:92) and N1110 (SEQ ID NO:96) for configuration "B". A geneticin selectable version of the "A" configuration vector was then made by removing the URA3 gene (1.2 kb NotI/NaeI fragment) and adding a geneticin cassette (SEQ ID NO: 244 herein; previously described in U.S. Appln. No. 61/356, 379, filed Jun. 18, 2010, incorporated herein by reference) maintained in a pUC19 vector (cloned at the SmaI site). The kan gene was isolated from pUC19 by first digesting with KpnI, removal of 3' overhanging DNA using Klenow Fragment (NEB, Cat. No. M212), digesting with HincII and then gel purifying the 1.8 kb gene fragment (Zymoclean™ Gel DNA Recovery Kit, Cat. No. D4001, Zymo Research, Orange, Calif.; SEQ ID NO: 245). Klenow fragment was used to make all ends compatible for ligation, and transformants were screened by PCR to select a clone with the geneticin resistance gene in the same orientation as the previous URA3 marker using primers BK468 (SEQ ID NO:90) and N160SeqF5 (SEQ ID NO:94). The resulting clone was called pUC19-kan::pdc1::FBA-alsS::TRX1 (clone A) (SEQ ID NO:131).

Construction of alsS Integrant Strains and Isobutanol-Producing Derivatives

Figure 5:
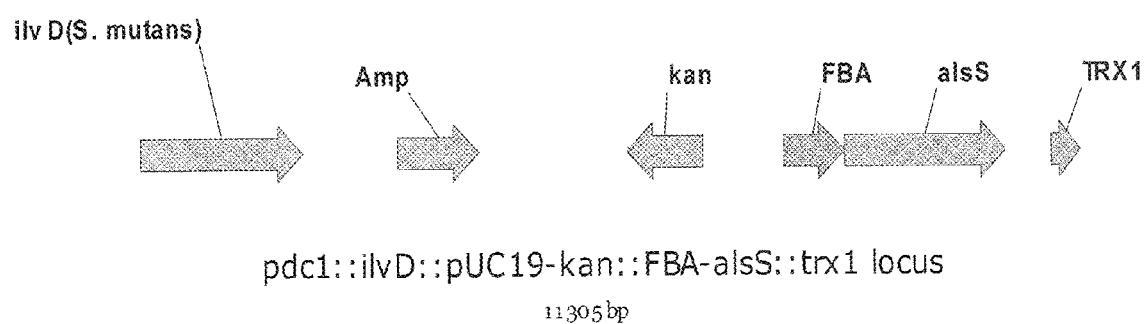
FIG. 5 shows the PNY2204 locus (pdc1Δ::ilvD::pUC19-kan::FBA-alsS::TRX1).

The pUC19-kan::pdc1::FBA-alsS integration vector described above was linearized with PmeI and transformed into PNY1507 (described above in Example 1). PmeI cuts the vector within the cloned pdc1-TRX1 intergenic region and thus leads to targeted integration at that location (Rodney Rothstein, Methods in Enzymology, 1991, volume 194, pp. 281-301). Transformants were selected on YPE plus 50 µg/ml G418. Patched transformants were screened by PCR for the integration event using primers N160SeqF5 (SEQ ID NO:94) and oBP512 (SEQ ID NO:98). Two transformants were tested indirectly for acetolactate synthase function by evaluating the strains ability to make isobutanol. To do this, additional isobutanol pathway genes were supplied on E. coli-yeast shuttle vectors (pYZ090ΔalsS and pBP915, described below). One clone, strain MATa ura3Δ::loxP his3Δ pdc6Δ pdc1Δ::P[PDC1]-DHAD|ilvD_Sm-PDC1t-pUC19-kan-kanMX-loxP-P [FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t was designated as PNY2204. The plasmid-free parent strain was designated PNY2204. The PNY2204 locus (pdc1Δ::ilvD::pUC19-kan::FBA-alsS::TRX1) is depicted in FIG. 5.

Isobutanol Pathway Plasmids (pYZ090ΔalsS and pBP915)

pYZ090 (SEQ ID NO:134) was digested with SpeI and NotI to remove most of the CUP1 promoter and all of the alsS coding sequence and CYC terminator. The vector was then self-ligated after treatment with Klenow fragment and transformed into E. coli Stbl3 cells, selecting for ampicillin resistance. Removal of the DNA region was confirmed for two independent clones by DNA sequencing across the ligation junction by PCR using primer N191 (SEQ ID NO:95). The resulting plasmid was named pYZ090ΔalsS (SEQ ID NO:132).

pBP915 was constructed from pLH468 (SEQ ID NO:124) by deleting the kivD gene and 957 base pairs of the TDH3 promoter upstream of kivD. pLH468 was digested with SwaI and the large fragment (12896 bp) was purified on an agarose gel followed by a Gel Extraction kit (Qiagen; Valencia, Calif.). The isolated fragment of DNA was self-ligated with T4 DNA ligase and used to transform electrocompetent TOP10 Escherichia coli (Invitrogen; Carlsbad, Calif.). Plasmids from transformants were isolated and checked for the proper deletion by restriction analysis with the SwaI restriction enzyme. Isolates were also sequenced across the deletion site with primers oBP556 (SEQ ID NO:127) and oBP561 (SEQ ID NO:128). A clone with the proper deletion was designated pBP915 (pLH468ΔkivD) (SEQ ID NO:133).

Example 4

Isobutanol Production in Strains with an Integrated Copy of the kivD Gene

The purpose of this example is to show isobutanol production in strains with an integrated copy of the kivD gene compared to strains with plasmid-borne kivD. Strains without the kivD integration, carrying plasmids pYZ090 and pLH468, were compared to the integration strain, PNY1507, carrying plasmid pYZ090 and pBP915. All media components were from Sigma-Aldrich, St. Louis, Mo. Strains were grown in synthetic medium (Yeast Nitrogen Base Without Amino Acids and Yeast Synthetic Drop-Out Media Supplement without uracil, histidine, tryptophan, and leucine) supplemented with 76 mg/L tryptophan, 380 mg/L leucine, 100 mM MES pH5.5, 20 mg/L nicotinic acid, 20 mg/L thiamine hydrochloride, 0.2% glucose, and 0.2% ethanol. Overnight cultures were grown in 8 ml of medium in 125 ml vented Erlenmeyer flasks at 30° C., 250 RPM in a New Brunswick Scientific 124 shaker. 19 mL of medium in 125 mL tightly-capped Erlenmeyer flasks was inoculated with overnight culture to an OD600 0.5 and grown for 8 hours at 30° C., 250 RPM in a New Brunswick Scientific 124 shaker. Glucose was added to 2% (time 0 hours). After 48 hours, culture supernatants (collected using Spin-X centrifuge tube filter units, Costar Cat. No. 8169) were analyzed by HPLC per methods described in U.S. Appl. Pub. No. 20070092957. Results are shown in Table 3. The strains with an integrated copy of the kivD gene has a similar isobutanol titer compared to strains with plasmid-borne kivD.

TABLE 3

Isobutanol titer in strains with an integrated or plasmid-borne kivD gene

| Strain | Isobutanol Titer (g/L) |
|---|---|
| PNY1506 (BP1168) | 1.7 +/− 0.3 (n = 2*) |
| PNY1507/pYZ090/pBP915 | 1.8 +/− 0.1 (n = 2#) |

*Biological replicates
Independent transformants

Example 5

Isobutanol Production in Strains with an Integrated Copy of the alsS Gene

The purpose of this example is to show increased production of isobutanol when the acetolactate synthase was removed from a plasmid and integrated into the yeast genome. Strains without alsS integration (PNY1507 carrying plasmids pYZ090 and pBP915) were compared to the integration strains (PNY2204 carrying plasmid pYZ090DalsS and pBP915). All strains were grown in synthetic complete medium, minus histidine and uracil containing 0.3% glucose and 0.3% ethanol as carbon sources (10 mL medium in 125 mL vented Erlenmeyer flasks (VWR Cat. No. 89095-260). After overnight incubation (30° C., 250 rpm in an Innova®40 New Brunswick Scientific Shaker), cultures were diluted back to 0.2 OD (Eppendorf BioPhotometer measurement) in synthetic complete medium containing 2% glucose and 0.05% ethanol (20 ml medium in 125 mL tightly-capped Erlenmeyer flasks (VWR Cat. No. 89095-260)). After 48 hours incubation (30° C., 250 rpm in an Innova®40 New Brunswick Scientific Shaker), culture supernatants (collected using Spin-X centrifuge tube filter units, Costar Cat. No. 8169) were analyzed by HPLC per methods described in U.S. Appl. Pub. No. 20070092957. Results are shown below in Table 4. The isobutanol titer from strains with an integrated copy of the alsS gene were significantly greater than the isobutanol titer without alsS integration.

TABLE 4

Isobutanol titer in strains with or without alsS gene integration

| Strain | Isobutanol Titer (g/L) |
|---|---|
| PNY1507/pYZ090/pBP915 | 1.5 +/− 0.2 (n = 3*) |
| PNY2204/pYZ090ΔalsS/pBP915 (PNY2205) | 2.6 +/− 0.1 (n = 3*) |

*Biological replicates

Example 6

Isobutanol Production in Strains with an Integrated Copy of the alsS Gene

The purpose of this Example is to show increased cell density and production of isobutanol when the acetolactate synthase was removed from a plasmid and integrated into the yeast genome. Strains without alsS integration (PNY1504 as described in U.S. Appln. No. 61/379,546, filed Sep. 2, 2010, incorporated herein by reference, and PNY1506) were compared to the integration strain PNY2205 (PNY2204 transformed with pYZ09ΔalsS and pBP915 plasmids and having alsS integration).

Inoculum and Bioreactor Media

A yeast inoculum media (1 L) was prepared containing 6.7 g of Yeast Nitrogen Base w/o amino acids (Difco 0919-15-3); 2.8 g Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 0.8 mL of Ergosterol & Tween solution; 3 g of ethanol; and 3 g of glucose. For 10 mL Ergosterol & Tween solution, 100 mg of Ergosterol was dissolved in 5 mL 100% ethanol and 5 mL Tween 80. The solution was heated for 10 min at 70° C.

A 125 mL shake flask was inoculated directly from a frozen vial by pipetting the whole vial culture (approx. 1 ml) into 10 mL of the inoculum medium. The flask was incubated at 260 rpm and 30° C. The strain was grown overnight until OD about 1.0. OD at λ=600 nm was determined in a HEλIOS α spectrophotometer (Thermo Electron Corporation, USA). At this point, a 2 L shake flask containing 110 mL of the inoculum medium were inoculated from the overnight culture. The starting OD in the 2 L flask was 0.1. The flask was incubated at 260 rpm and 30° C. When OD in the shake flask reached about 1.0, 20 ml, of 1M MES buffer, 20 mL of 10× yeast extract and peptone (YEP), glucose up to final concentration of 30 g/L and about 160 mL of oleyl alcohol (90-95%, Cognis, Cincinnati Ohio, USA) were added to the shake flask. 24 hours afterwards, the oleyl alcohol was removed and bioreactors inoculated.

A 10×YEP solution was prepared by dissolving 100 g of yeast extract and 200 of peptone in water to a final volume of 1 L.

A bioreactor medium (1 L) was prepared containing:

(i) salts: ammonium sulfate 5.0 g, potassium phosphate monobasic 2.8 g, magnesium sulfate heptahydrate 1.9 g, zinc sulfate heptahydrate 0.2 g;

(ii) vitamins: biotin (D-) 0.40 mg, Ca D(+) panthotenate 8.00 mg, myo-inositol 200.00 mg, pyridoxol hydrochloride 8.00 mg, p-aminobenzoic acid 1.60 mg, riboflavin 1.60 mg, folic acid 0.02 mg, niacin 30.0 mg, and thiamine 30 mg;

(iii) amino acids: yeast synthetic drop-out medium supplement without histidine, leucine, tryptophan and uracil (Sigma Y2001) 2.8 g, 1% (w/v) L-leucine 20 mL, and 1% (w/v) L-tryptophan 4 mL; and (iv) trace elements: EDTA (Titriplex III7) 99.38 mg, zinc sulphate heptahydrate 29.81 mg, manganese chloride dehydrate 5.57 mg, cobalt(II)chloride hexahydrate 1.99 mg, copper(II)sulphate pentahydrate 1.99 mg, Di-sodium molybdenum dehydrate 2.65 mg, calcium chloride dehydrate 29.81 mg, iron sulphate heptahydrate 19.88 mg, boric acid.

Bioreactor Experimental Design

Experiments were executed in 2 L BIOSTAT B-DCU Tween2 L bioreactors from Sartorius (USA). The fermentors are connected to mass-spec from Thermo Electron Corporation (USA) Directly after inoculation with 80 mL of the inoculum the volume in fermentors was about 800 mL, dissolved oxygen tension (DOT) was controlled at 10%, pH was controlled at 5.25, aeration was controlled at 0.5 L/min, 0.8 L of oleyl alcohol was added. Oleyl alcohol was used in order to extract isobutanol from culture broth.

Methods for Analyzing Cultivation Experiments

Optical density (OD) at λ=600 nm was determined using a spectrophotometer by pipetting a well mixed broth sample into an appropriate cuvette (CS500 VWR International, Germany). If the biomass concentration of the sample exceeded the linear absorption range of the spectrophotometer (typically OD values from 0.000 to 0.600), the sample was diluted with 0.9% NaCl solution to yield values in the linear range.

Metabolites and products in medium were analyzed and quantified using a GC method and an ZB-WAXplus column (30 m×0.25 mm ID, 0.25 μm film) from Phenomenex (Torrance, Calif.). A helium carrier gas was used at a constant flow rate of 2.3 mL/min; an injector split of 1:20 at 250° C.; an oven temperature of 70° C. for 1 min, followed by 70° C. to 160° C. at 10° C./min, and 160° C. to 240° C. at 30° C./min. Flame Ionization Detection (FID) was used at 260° C. with 40 mL/min helium makeup gas. Culture broth samples were filtered through 0.2 μm spin filters before injection. 0.5 μl injection volumes were used. Calibrated standard curves were generated for isobutanol.

Glucose and fermentation by-product analysis were carried out by high performance liquid chromatography (HPLC) using methods known in the art. The HPLC method utilized a Shodex SH-1011 column with a Shodex SH-G guard column (both available from Waters Corporation, Milford, Mass.), with refractive index (RI) detection. Chromatographic separation was achieved using 0.01 N $H_2SO_4$ as the mobile phase with a flow rate of 0.5 mL/min and a column temperature of 50° C. Isobutanol retention time was 47.6 minutes.

Isobutanol concentration in the culture supernatant was determined by the HPLC method. Isobutanol concentration in the oleyl alcohol phase was determined by the GC method. Isobutanol concentration in off-gas samples was determined by mass-spec as mentioned above.

Results

The measured values of optical density (OD), isobutanol production rate (R), produced isobutanol per liter of culture broth (isobutanol titer, T), and isobutanol yield per consumed glucose (Y) at about 46 hours of fermentation time are presented in Table 5. The PNY2205 strain compared to PNY1504 and PNY1506 strains grow to higher cell density and resulted in higher titer and rate but similar yield.

TABLE 5

Optical density, isobutanol production rate, titer and yield in
PNY1504, PNY1506 and PNY2205 strains

| Strain | OD | R (g/L/h) | T (g/L) | Y (g/g) |
|---|---|---|---|---|
| PNY1504 | 26.5 | 0.45 | 20.7 | 0.27 |
| PNY1506 | 27.2 | 0.55 | 25.2 | 0.28 |
| PNY2205 | 34.6 | 0.84 | 39.7 | 0.27 |

Example 7

Comparing the Performance of Strains PNY1504 and PNY2205 Under the Same Reactive Liquid Extraction Conditions Stock Solutions Used
Pre-Seed Media The following reagents were mixed with gentle agitation at room temperature: 6.7 g of Yeast Nitrogen Base without amino acids (Difco 0919-15-3); 2.8 g of Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 3 g of glucose and enough water to make a total of 1 L of solution.

Seed Flask Media

The following reagents were mixed with gentle agitation at room temperature: 6.7 g of Yeast Nitrogen Base without amino acids (Difco 0919-15-3); 2.8 g of Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 30 g of glucose; 38 g of MES buffer (Sigma-Aldrich YXXX) and enough water to make a total of 1 L of solution. After mixing, the solution was filter sterilized.

Ergosterol Solution

A solution of 0.2 g of Ergosterol, 10 mL of 200 proof ethanol and 10 ml of Tween 80 was mixed and heated to 70° C. for 10 minutes.

Distillase Stock Solution

A solution of 0.9 mL of Distillase L 400 and 49.1 mL of filter sterilized tap water was mixed.

Lipolase 100L Stock Solution

A solution of 2.12 mL of Lipolase 100L (Sigma Aldrich L0777) and 40 g of phosphate buffer solution at pH 6.8 were mixed and filter sterilized.

Vitamin Stock Solution 5 g of nicotinic acid and 1 g of thiamine were mixed in 500 mL of filter sterilized Deionized water.

Corn Mash

Corn mash was added to a 30 L liquefaction tank. Next, 16910 g of tap water was added to the 30 L liquefaction tank with agitation at 120 rpm. The tank was outfitted with a dual-blade pitched-blade turbine with $D_{B/DT}$=~0.25. Next, 14091 g of ground corn (ground in a Hammer Mill with a 1 micron screen) was added, and the mash was heated to 55° C. and held there for 30 minutes. The pH was adjusted to 5.8 by adding 5.4 g of 17% NaOH solution in water. An alpha-amylase enzyme solution was prepared by mixing 1986 g of tap water and 19.5 g of Spezyme Fred L from Genencor and sterile filtered the resulting solution through a 0.2 micron filter. 2004 g of this solution was added to the 30 L liquefaction tank and held at 55° C. for an additional 60 minutes. The solution was then heated to 95° C. and held at that temperature for 120 minutes. The solution was cooled to 30° C. before using in fermentation.

PNY1504 Process
Pre-Seed Growth 30 mL of Pre-Seed Media was added to a 250 mL baffled, vented shake flask. Next, 2 Frozen Seed Vials of Strain PNY1504, ca. 1.5 mL of total volume, were added to the same flask. The culture was then incubated for 24 hours at 30° C. at 250 rpm on an incubator shaker.

Seed Flask Stage 1

15 mL of the pre-seed culture was added to 300 mL of the Seed Flask media in a 2 L baffled, vented shake flask. The flask was incubated for 24 hours at 30° C. and 250 rpm on an incubator shaker.

Seed Flask Stage 2

30 mL of yeast extract peptone and 300 mL of sterile oleyl alcohol were then added to the flask. The flask was incubated for 24 hours at 30° C. at 250 rpm on an incubator shaker.

1 L Production Fermentor

A 1 L fermentor with water covering the probes was sterilized for 30 min at 121° C. The water was drained and 520 mL of sterile corn mash media was added. Next, the following aseptic additions to the corn mash were made in the fermentor: 3.8 mL of ethanol, 0.6 mL of 1% ergosterol solution, 6 mL of nicotinic acid/thiamine solution and 4.8 mL of Liplolase 100L stock solution. Next, 60 mL of the aqueous phase of Seed Flask Stage 2 was added, followed by 2 mL of the Distillase stock solution. Directly thereafter, 96 mL of corn oil fatty acid was added. After 12 hours, 2 mL of the Distillase Stock solution was added. At 24 hours post inoculation, another 2 mL of Distillase Stock solution was added. The solution was then incubated at pH 5.2, temperature 30° C. and a pO2 (partial pressure of dissolved oxygen) setpoint of 3%. Airflow was set at 0.2 slpm (standard liters per minute) and the pO2 was controlled via agitation. pH was controlled with 20% w/v KOH solution and no acid was required throughout the fermentation. Samples were taken and analyzed over the course of the fermentation.

PNY2205 Process
Pre-Seed Growth 30 mL of Pre-Seed Media was added to a 250 mL baffled, vented shake flask. Next, 2 Frozen Seed Vials of Strain PNY2205, ca. 1.5 mL of total volume, were added to the same flask. We then held the flask for 24 hours at 30° C. at 250 rpm on an incubator shaker.

Seed Flask Stage 1

300 mL of the Seed Flask media was added to a 2 L baffled, vented shake flask. 15 mL of pre-seed culture was added flask and incubated for 24 hours at 30° C. and 250 rpm on an incubator shaker.

Seed Flask Stage 2

30 mL of yeast extract peptone and 300 mL of sterile oleyl alcohol was added to the flask and the flask was incubated for 24 hours at 30° C. and 250 rpm on an incubator shaker.

1 L Production Fermentor

A 1 L fermentor with water covering the probes was sterilized for 30 min at 121° C. The water was drained and 520 mL of sterile corn mash media was added. Next, the following aseptic additions were made to the corn mash in the fermentor: 3.8 mL of ethanol, 0.6 mL of 1% ergosterol solution, 6 mL of nicotinic acid/thiamine solution and 4.8 mL of Liplolase 100L stock solution. Next, 60 mL of the aqueous phase of Seed Flask Stage 2 was added, followed by 2 mL of the Distillase stock solution. Directly thereafter, 96 mL of corn oil fatty acid was added. 12 hours post inoculation, 2 mL of the Distillase Stock solution was added. At 24 hours post inoculation, 2 mL of Distillase Stock solution was also added. The solution was incubated at pH 5.2, temperature 30° C. and the pO2 setpoint of 3%. Airflow was set at 0.2 slpm and the pO2 was controlled via agitation. pH was controlled with 20% w/v KOH solution and no acid was required throughout the fermentation. Samples were taken and analyzed over the course of the fermentation.

Methods for Analyzing Cultivation Experiments

Optical density (OD) of the resulting cultures was measured at λ=600 nm using a spectrophotometer. First, a well mixed broth sample was pipetted into an appropriate cuvette. When the biomass concentration of the sample exceeded the linear absorption range of the spectrophotometer (typically OD values from 0.000 to 0.600), the sample was diluted with 0.9% NaCl solution to yield values in the linear range. Dry weight of the cell suspension was determined by centrifuging 5 mL of cell broth in a pre-weighed centrifuge tube, followed by washing with distilled water, drying to constant weight at 80° C. in an oven and determining the weight difference.

Metabolites and products in medium were analyzed and quantified by a GC method utilizing a ZB-WAXplus column (30 m×0.25 mm ID, 0.25 µm film) from Phenomenex (Torrance, Calif.). The carrier gas was helium at a constant flow rate of 2.3 mL/min; injector split was 1:20 at 250° C.; oven temperature is 70° C. for 1 min, 70° C. to 160° C. at 10° C./min, and 160° C. to 240° C. at 30° C./min. FID detection was used at 260° C. with 40 ml/min helium makeup gas. Culture broth samples were filtered through 0.2 µm spin filters before injection. A calibrated standard curve for isobutanol (w-methyl-1-propanol) was used.

Glucose analysis was carried out by YSI (YSI 2700 Select biochemistry analyzer that uses enzyme electrode technology to generate rapid measurement of glucose concentration.

Results

Isobutanol production rate, isobutanol per liter of culture broth (effective titer), and isobutanol yield per consumed glucose are presented in Table 6. The PNY2205 strain compared to PNY1504 strains resulted in higher production rate and titer but similar yield.

TABLE 6

Optical density and isobutanol production of PNY2205 compared to PNY1504

| 52-56 hr result | PNY1504 | PNY2205 |
|---|---|---|
| rate, g/L-h | 0.50 | 0.64 |
| effective titer (g/L) | 26.3 | 35.5 |
| g/g glu yield | 0.27 | 0.27 |

Example 8

Comparing the Performance of Strains PNY1504 and PNY2205 Under the Same Reactive Liquid Extraction Conditions Stock Solutions Used
Pre-Seed Media The following reagents were mixed with gentle agitation at room temperature: 6.7 g of Yeast Nitrogen Base without amino acids (Difco 0919-15-3); 2.8 g of Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 3 g of glucose and enough water to make a total of 1 L of solution.

Seed Flask Media

The following reagents were mixed with gentle agitation at room temperature: 6.7 g of Yeast Nitrogen Base without amino acids (Difco 0919-15-3); 2.8 g of Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 30 g of glucose; 38 g of MES buffer (Sigma-Aldrich YXXX) and enough water to make a total of 1 L of solution. After mixing, the solution was filter sterilized.

Ergosterol Solution

A solution of 0.2 g of Ergosterol, 10 mL of 200 proof ethanol and 10 mL of Tween 80 was mixed and heated to 70° C. for 10 minutes.

Distillase Stock Solution

A solution of 0.9 mL of Distillase L 400 and 49.1 mL of filter sterilized tap water was mixed.

Lipolase 100L Stock Solution

A solution of 2.12 mL of Lipolase 100L (Sigma Aldrich L0777) and 40 g of phosphate buffer solution at pH 6.8 was mixed and filter sterilized.

Vitamin Stock Solution

A solution of 5 g of nicotinic acid and 1 g of thiamine in was mixed in 500 mL of filter sterilized Deionized water.

Corn Mash

Corn mash was added to a 30 L liquefaction tank. Next, 16910 g of tap water was added to the 30 L liquefaction tank with agitation at 120 rpm. The tank was outfitted with a dual-blade pitched-blade turbine with $D_{B/DT}$=~0.25. Next, 14091 g of ground corn (ground in a Hammer Mill with a 1 micron screen) was added and the mash heated to 55° C. and incubated for 30 minutes. The pH was adjusted to 5.8 by adding 5.4 g of 17% NaOH solution in water. An alpha-amylase enzyme solution was prepared by mixing 1986 g of tap water and 19.5 g of Spezyme Fred L from Genencor and sterile filtering through a 0.2 micron filter. 2004 g of this solution was added to the 30 L liquefaction tank and incubated at 55° C. for an additional 60 minutes. Then, the solution was heated to 95° C. and held there for 120 minutes. The solution was then cooled to 30° C. before using in fermentation.

PNY1504 Process

Pre-Seed Growth 30 mL of Pre-Seed Media was added to a 250 mL baffled, vented shake flask. Next, 2 Frozen Seed Vials of Strain PNY1504, ca. 1.5 ml of total volume, were added to the same flask. The culture was incubated for 24 hours at 30° C. at 250 rpm on an incubator shaker.

Seed Flask Stage 1

300 mL of the Seed Flask media was added to a 2 L baffled, vented shake flask. 15 mL of pre-seed was then transferred to flask. The flask was then incubated for 24 hours at 30° C. and 250 rpm on an incubator shaker.

Seed Flask Stage 2

30 mL of yeast extract peptone and 300 mL of sterile oleyl alcohol were added to the flask and the flask incubated for 24 hours at 30° C. at 250 rpm on an incubator shaker.

1 L Production Fermentor

A 1 L fermentor with water covering the probes was sterilized for 30 min at 121° C. The water was drained and 520 mL of sterile corn mash media was added. Next, the following aseptic additions were made to the corn mash in the fermentor: 3.8 mL of ethanol, 0.6 mL of 1% ergosterol solution, 6 mL of nicotinic acid/thiamine solution and 4.8 mL of Liplolase 100L stock solution. Next, 60 mL of the aqueous phase of Seed Flask Stage 2 was added, followed by 2 mL of the Distillase stock solution. Directly thereafter, 141 mL of corn oil fatty acid was added. At 12 hours post inoculation, 2 mL of the Distillase Stock solution was added. At 24 hours post inoculation, 2 mL of Distillase Stock solution was also added. The solution was then incubated at pH 5.2, temperature 30° C. and pO2 setpoint of 3%. Airflow was set at 0.2 slpm and pO2 was controlled via agitation. pH was controlled with 20% w/v KOH solution and no acid was required throughout the fermentation. Samples were taken and analyzed over the course of the fermentation.

PNY2205 Process

Pre-Seed Growth 30 mL of Pre-Seed Media was added to a 250 mL baffled, vented shake flask. Next, 2 Frozen Seed Vials of Strain PNY2205, ca. 1.5 ml of total volume, were added to the same flask. The flask was then incubated for 24 hours at 30° C. at 250 rpm on an incubator shaker.

Seed Flask Stage 1

300 mL of the Seed Flask media was added to a 2 L baffled, vented shake flask. 15 mL of the pre-seed growth was then added to the flask and incubated for 24 hours at 30° C. and 250 rpm on an incubator shaker.

Seed Flask Stage 2

30 mL of yeast extract peptone and 300 mL of sterile oleyl alcohol were added to the flask and incubated for 24 hours at 30° C. and 250 rpm on an incubator shaker.

1 L Production Fermentor

A 1 L fermentor with water covering the probes was sterilized for 30 min at 121° C. The water was drained and 520 mL of sterile corn mash media was added. Next, the following aseptic additions were made to the corn mash in the fermentor: 3.8 mL of ethanol, 0.6 mL of 1% ergosterol solution, 6 mL of nicotinic acid/thiamine solution and 4.8 mL of Liplolase 100L stock solution. Next, 60 mL of the aqueous phase of Seed Flask Stage 2 was added followed by 2 mL of the Distillase stock solution. Directly thereafter, 96 mL of corn oil fatty acid was added. At 12 hours post inoculation, 2 mL of the Distillase Stock solution was added. At 24 hours post inoculation, 2 mL of Distillase Stock solution was also added and the solution was incubated at pH 5.2, temperature 30° C. and pO2 setpoint of 3%. Airflow was set at 0.2 slpm and pO2 was controlled via agitation. pH was controlled with 20% w/v KOH solution and no acid was required throughout the fermentation. Samples were taken and analyzed over the course of the fermentation.

Results

Isobutanol production rate, isobutanol per liter of culture broth (effective titer), and isobutanol yield per consumed glucose are presented in Table 7. The PNY2205 strain compared to PNY1504 strains resulted in higher production rate and titer but similar yield.

TABLE 7

Optical density and isobutanol production of PNY2205 compared to PNY1504

| 52-56 hr result | PNY1504 | PNY2205 |
|---|---|---|
| rate, g/l-h | 0.48 | 0.54 |
| effective titer (g/l) | 25.2 | 30.1 |
| g/g glu yield | 0.27 | 0.27 |

Example 9

Comparing the Performance of Strains PNY1504 and PNY2205 Under the Same Reactive Liquid Extraction Conditions Stock Solutions Used Pre-Seed Media The following reagents were mixed with gentle agitation at room temperature: 6.7 g of Yeast Nitrogen Base without amino acids (Difco 0919-15-3); 2.8 g of Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 3 g of glucose and enough water to make a total of 1 L of solution.

Seed Flask Media

The following reagents were mixed with gentle agitation at room temperature: 6.7 g of Yeast Nitrogen Base without amino acids (Difco 0919-15-3); 2.8 g of Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 30 g of glucose; 38 g of MES buffer (Sigma-Aldrich YXXX) and enough water to make a total of 1 L of solution. After mixing, the solution was filter sterilized.

Ergosterol Solution

A solution of 0.2 g of Ergosterol, 10 mL of 200 proof ethanol and 10 mL of Tween 80 was mixed and heated to 70° C. for 10 minutes.

Distillase Stock Solution

A solution of 0.9 mL of Distillase L 400 and 49.1 mL of filter sterilized tap water was mixed.

Lipolase 100L Stock Solution

A solution of 2.12 mL of Lipolase 100L (Sigma Aldrich L0777) and 40 g of phosphate buffer solution at pH 6.8 was mixed and filter sterilized.

Vitamin Stock Solution

A solution of 5 g of nicotinic acid and 1 g of thiamine in was mixed in 500 mL of filter sterilized Deionized water.

Corn Mash

Corn mash was added to a 30 L liquefaction tank. Next, 16910 g of tap water was added to the 30 L liquefaction tank with agitation at 120 rpm. The tank was outfitted with a dual-blade pitched-blade turbine with $D_{B/DT}=\sim 0.25$. Next, 14091 g of ground corn (ground in a Hammer Mill with a 1 micron screen) was added and the mash heated to 55° C. and incubated for 30 minutes. The pH was adjusted to 5.8 by adding 5.4 g of 17% NaOH solution in water. An alpha-amylase enzyme solution was prepared by mixing 1986 g of tap water and 19.5 g of Spezyme Fred L from Genencor and sterile filtering through a 0.2 micron filter. 2004 g of this solution was added to the 30 L liquefaction tank and incubated at 55° C. for an additional 60 minutes. Then, the solution was heated to 95° C. and held there for 120 minutes. The solution was then cooled to 30° C. before using in fermentation.

PNY1504 Process

Pre-Seed Growth 30 mL of Pre-Seed Media was added to a 250 mL baffled, vented shake flask. Next, 2 Frozen Seed Vials of Strain PNY1504, ca. 1.5 ml of total volume, were added to the same flask. The culture was incubated for 24 hours at 30° C. at 250 rpm on an incubator shaker.

Seed Flask Stage 1

300 mL of the Seed Flask media was added to a 2 L baffled, vented shake flask. 15 mL of pre-seed was then transferred to flask. The flask was then incubated for 24 hours at 30° C. and 250 rpm on an incubator shaker.

Seed Flask Stage 2

30 mL of yeast extract peptone and 300 mL of sterile oleyl alcohol were added to the flask and the flask incubated for 24 hours at 30° C. at 250 rpm on an incubator shaker.

1 L Production Fermentor

A 1 L fermentor with water covering the probes was sterilized for 30 min at 121° C. The water was drained and 520 mL of sterile corn mash media was added. Next, the following aseptic additions were made to the corn mash in the fermentor: 3.8 mL of ethanol, 0.6 mL of 1% ergosterol solution, 6 mL of nicotinic acid/thiamine solution and 4.8 mL of Liplolase 100L stock solution. Next, 60 mL of the aqueous phase of Seed Flask Stage 2 was added, followed by 2 mL of the Distillase stock solution. Directly thereafter, 141 mL of corn oil fatty acid was added. At 12 hours post inoculation, 2 mL of the Distillase Stock solution was added. At 24 hours post inoculation, 2 mL of Distillase Stock solution was also added. The solution was then incubated at pH 5.2, temperature 30° C. and pO2 setpoint of 3%. Airflow was set at 0.2 slpm and pO2 was controlled via agitation. pH was controlled with 20% w/v KOH solution and no acid was required throughout the fermentation. Samples were taken and analyzed over the course of the fermentation.

PNY2205 Process

Pre-Seed Growth 30 mL of Pre-Seed Media was added to a 250 mL baffled, vented shake flask. Next, 2 Frozen Seed Vials of Strain PNY2205, ca. 1.5 ml of total volume, were added to the same flask. The flask was then incubated for 24 hours at 30° C. at 250 rpm on an incubator shaker.

Seed Flask Stage 1

300 mL of the Seed Flask media was added to a 2L baffled, vented shake flask. 15 mL of the pre-seed growth was then added to the flask and incubated for 24 hours at 30° C. and 250 rpm on an incubator shaker.

Seed Flask Stage 2

30 mL of yeast extract peptone and 300 mL of sterile oleyl alcohol were added to the flask and the flask incubated for 24 hours at 30° C. and 250 rpm on an incubator shaker.

1 L Production Fermentor

A 1 L fermentor with water covering the probes was sterilized for 30 min at 121° C. The water was drained and 520 mL of sterile corn mash media was added. Next, the following aseptic additions were made to the corn mash in the fermentor: 3.8 mL of ethanol, 0.6 mL of 1% ergosterol solution, 6 mL of nicotinic acid/thiamine solution and 4.8 mL of Liplolase 100L stock solution. Next, 60 mL of the aqueous phase of Seed Flask Stage 2 was added followed by 2 mL of the Distillase stock solution. Directly thereafter, 96 mL of corn oil fatty acid was added. At 12 hours post inoculation, 2 mL of the Distillase Stock solution was added. At 24 hours post inoculation, 2 mL of Distillase Stock solution was also added and the solution was incubated at pH 5.2, temperature 30° C. and pO2 setpoint of 3%. Airflow was set at 0.2 slpm and pO2 was controlled via agitation. pH was controlled with 20% w/v KOH solution and no acid was required throughout the fermentation. Samples were taken and analyzed over the course of the fermentation.

Results

Isobutanol production rate, isobutanol per liter of culture broth (effective titer), and isobutanol yield per consumed glucose are presented in Table 8. The PNY2205 strain compared to PNY1504 strains resulted in higher production rate and titer but similar yield.

TABLE 8

Isobutanol production of PNY2205 compared to PNY1504

| 52-56 hr result | PNY1504 | PNY2205 |
|---|---|---|
| rate, g/l-h | 0.51 | 0.58 |
| effective titer (g/l) | 26.7 | 32.6 |
| g/g glu yield | 0.27 | 0.27 |

Example 10

Construction of S. cerevisiae Strain PNY2211

PNY2211 was constructed in several steps from S. cerevisiae strain PNY1507 (Example 2) as described in the following paragraphs. First, the strain was modified to contain a phosphoketolase gene. Construction of phosphoketolase gene cassettes and integration strains was previously described in U.S. Appl. No. 61/356,379, filed Jun. 18, 2010. Next, an acetolactate synthase gene (alsS) was added to the strain, using an integration vector described in Example 3. Finally, homologous recombination was used to remove the phosphoketolase gene and integration vector sequences, resulting in a scarless insertion of alsS in the intergenic region between pdc1Δ::ilvD (a previously described deletion/insertion of the PDC10RF, U.S. Appl. No. 61/356,379, filed Jun. 18, 2010; see Example 1 herein) and the native TRX1 gene of chromosome XII. The resulting genotype of PNY2211 is MATa ura3Δ::loxP his3Δ pdc6Δ pdc1Δ::P[PDC1]-DHAD|ilvD_Sm-PDC1t-P [FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t.

A phosphoketolase gene cassette was introduced into PNY1507 by homologous recombination. The integration construct was generated as follows. The plasmid pRS423:: CUP1-alsS+FBA-budA (described in U.S. Pub. No. 2009/0305363 A1) was digested with NotI and XmaI to remove the 1.8 kb FBA-budA sequence, and the vector was religated after treatment with Klenow fragment. Next, the CUP1 promoter was replaced with a TEF1 promoter variant (M4 variant described by Nevoigt et al. *Appl. Environ. Microbiol.* 2006. 72(8): 5266-5273) via DNA synthesis and vector construction service from DNA2.0 (Menlo Park, Calif.). The resulting plasmid, pRS423::TEF(M4)-alsS was cut with StuI and MluI (removes 1.6 kb portion containing part of the alsS gene and CYC1 terminator), combined with the 4 kb PCR product generated from pRS426::GPD-xpk1+ADH-eutD (described in U.S. Appl. No. 61/356,379, filed Jun. 18, 2010; SEQ ID NO: 246 herein) with primers N1176 (SEQ ID NO:207) and N1177 (SEQ ID NO:208) and an 0.8 kb PCR product DNA generated from yeast genomic DNA (ENOL promoter region) with primers N822 (SEQ ID NO:209) and N1178 (SEQ ID NO:210) and transformed into S. cerevisiae strain BY4741 (ATCC 201388; gap repair cloning methodology, see Ma and Botstein). Transformants were obtained by plating cells on synthetic complete medium without histidine. Proper assembly of the expected plasmid (pRS423::TEF (M4)-xpk1+ENO1-eutD, SEQ ID NO:211) was confirmed by PCR (primers N821 (SEQ ID NO:212) and N1115 (SEQ ID NO:213)) and by restriction digest (BglI). Two clones were subsequently sequenced. The 3.1 kb TEF(M4)-xpk1 gene was isolated by digestion with SacI and NotI and cloned into the pUC19-URA3::ilvD-TRX1 vector (described in U.S. Appl. No. 61/356,379, filed Jun. 18, 2010 SEQ ID NO: 243, herein) Clone A, cut with AflII). Cloning fragments were treated with Klenow fragment to generate blunt ends for ligation. Ligation reactions were transformed into *E. coli* Stb13 cells, selecting for ampicillin resistance. Insertion of TEF(M4)-xpk1 was confirmed by PCR (primers N1110 (SEQ ID NO:214) and N1114 (SEQ ID NO:215)). The vector was linearized with AflII and treated with Klenow fragment. The 1.8 kb KpnI-HincII geneticin resistance cassette (described in U.S. Appl. No. 61/356,379, filed Jun. 18, 2010; SEQ ID NO: 245 herein), was cloned by ligation after Klenow fragment treatment. Ligation reactions were transformed into *E. coli* Stb13 cells, selecting for ampicillin resistance. Insertion of the geneticin cassette was confirmed by PCR (primers N160SeqF5 (SEQ ID NO:216) and BK468 (SEQ ID NO:217)). The plasmid sequence is provided as SEQ ID NO:218 (pUC19-URA3::pdc1::TEF(M4)-xpk1::kan).

The resulting integration cassette (pdc1::TEF(M4)-xpk1:: KanMX::TRX1) was isolated (AscI and NaeI digestion generated a 5.3 kb band that was gel purified) and transformed into PNY1507 (Example 2) using the Zymo Research Frozen-EZ Yeast Transformation Kit (Cat. No. T2001). Transformants were selected by plating on YPE plus 50 μg/ml G418. Integration at the expected locus was confirmed by PCR (primers N886 (SEQ ID NO:219) and N1214 (SEQ ID NO:220)). Next, plasmid pRS423::GAL1p-Cre, encoding Cre recombinase, was used to remove the loxP-flanked KanMX cassette (vector and methods described herein). Proper removal of the cassette was confirmed by PCR (primers oBP512 (SEQ ID NO:221) and N160SeqF5 (SEQ ID NO:222)). Finally, the alsS integration plasmid described herein (pUC19-kan::pdc1::FBA-alsS::TRX1, clone A) was transformed into this strain using the included geneticin selection marker. Two integrants were tested for acetolactate synthase activity by transformation with plasmids pYZ09ΔalsS and pBP915 (plasmids described herein, transformed using Protocol #2 in "Methods in Yeast Genetics" 2005. Amberg, Burke and Strathern) and evaluation of growth and isobutanol production in glucose-containing media (methods for growth and isobutanol measurement are described herein and U.S. Appl. No. 60/730,290, filed Oct. 26, 2005 and U.S. Pub. No. 2007/0092957 A1). One of the two clones was positive and was named PNY2218. An isolate of PNY2218 containing the plasmids pYZ090ΔalsS and pBP915 was designated PNY2209.

Figure 6:
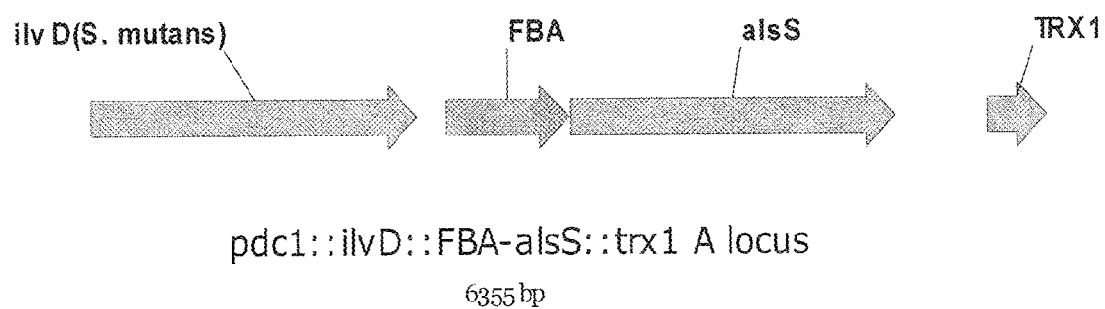
FIG. 6 shows the PNY2211 locus (pdc1Δ::ilvD::FBA-alsS::TRX1). The alsS gene integration in the pdc1-trx1 intergenic region is considered a "scarless" insertion since vector, marker gene and loxP sequences are lost.

PNY2218 was treated with Cre recombinase and resulting clones were screened for loss of the xpk1 gene and pUC19 integration vector sequences by PCR (primers N886 (SEQ ID NO:219) and N160SeqR5 (SEQ ID NO:222)). This leaves only the alsS gene integrated in the pdc1-TRX1 intergenic region after recombination the DNA upstream of xpk1 and the homologous DNA introduced during insertion of the integration vector (a "scarless" insertion since vector, marker gene and loxP sequences are lost, FIG. 6). Although this recombination could have occurred at any point, the vector integration appeared to be stable even without geneticin selection and the recombination event was only observed after introduction of the Cre recombinase. One clone was designated PNY2211.

Example 11

Comparing the Performance of Strains PNY2205 and PNY2211 Under the Same Reactive Liquid Extraction Conditions Isolates with the scarless integration (in particular, two clones "B" and "M") were transformed with pYZ090ΔalsS and pBP915 in order to compare isobutanol production with PNY2205. Integrants were selected on synthetic complete medium (minus histidine and uracil) containing 1% ethanol as the carbon source. Integrants were patched to the same medium, and patched cells were patched again to plates containing 2% glucose plus 0.05% ethanol as carbon sources. After two days, patches were used to inoculate liquid medium (10 mL synthetic complete, minus histidine and uracil, with 2% glucose and 0.05% ethanol in 125 mL vented flasks). After overnight incubation (30° C., 250 rpm) cultures were diluted back to OD 0.2 (20 mL medium in 125 mL tightly capped flasks). After 48 hours, samples were taken to determine isobutanol production. The new strain backgrounds supported similar isobutanol production to PNY2205. Clone M was selected for further engineering was named PNY2211. Clone M7 transformed with plasmids pYZ090DalsS and pBP915 was designated PNY2213.

The production of isobutanol per liter of culture broth (effective titer in g/L) of strains PNY2205, Clone B and Clone M is presented in Table 9. Clone B and M strains had a similar isobutanol titer compared to PNY2205.

TABLE 9

Isobutanol production of PNY2205 compared to PNY2211

| Strains | Isobutanol titer (g/L) |
|---|---|
| PNY2205 | 4.0 |
| Clone B strains (n = 3) | 3.8 +/− 0.5 |
| Clone M strains (n = 3)(PNY2213) | 4.0 +/− 0.5 |

SEQUENCE LISTING (248 sequences)

SEQ ID NO: 1 - DNA, 1680 bp, K. pneumoniae
atggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaa

SEQ ID NO: 2 - protein, 559 aa, K. pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 3 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 4 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 5 - DNA, 1665 bp, Lactococcus lactis
atgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattga

SEQ ID NO: 6 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 7 - DNA, 1665 bp, Staphylococcus aureus
  CDS (1)..(1665)
atgactgataaaaagtacactgcagccgatatggttattgatactttgaaaaataatggggtagaatatgtttttggtattccgggtgcaaagatagactatctatttaatgctttaattgatgatggtcctgaacttattgtcactcgtcatgaacaaaatgctgcaatgatggcacaaggtattggaagattaacaggtaaaccgggtgtagtacttgttacaagtggccctggtgtaagtaatttaacgactggactattaacagctacatctgaaggggatcctgtattagcgttaggtggccaagtgaaacgtaatgatttattacgattaacgcatcaaagtattgataatgctgcgctattaaaatattcatcaaaatacagtgaagaagtacaagatcctgaatcattatcagaagttatgacaaatgcaattcgaattgctacttcaggaaaaaatggcgcaagttttattagtattccgcaagacgttatttcttcaccagttgaatctaaagctatatcactttgccaaaaaccaaatttaggagtaccgagtgaacaagatattaatgatgtcattgaagcgattaaaaatgcatcatttcctgttttattagctggtatgagaagttcaagtgcagaagaaacaaatgccattcgcaaattagttgagcgcacgaatttaccagttgtagaaacattccaaggtgcaggtgtaattagtcgtgaattagaaaatcatttcttcggtcgtgtgggcttattccgcaatcaagttggtgatgaattattacgtaaaagtgatttagttgttacaatcggttatgatccaattgaatacgaagctagtaactggaataaagaattagaaacacaaattatcaatattgacgaagttcaagctgaaattactaattatatgcaaccgaaaaaagagttgattggtaatattgctaaaacgattgaaatgatttctgaaaaagtggatgagccatttataaatcaacaacatttagacgaattagaacaattaagaacacatattgatgaagaaactggtattaaagcgacgcatgaagaaggaattctacatccagtggaaattattgaatctatgcaaaaggtattaactgatgatactactgtaacagttgatgttggaagtcactatatttggatggcacgtaatttcagaagttacaatccaagacatttattatttagcaatggtatgcaaacgcttggtgtagcattaccgtgggcaatttcagctgcacttgtgcgccctaatacgcaagttgtgtccgttgctggcgatggtggctttttattttcatcacaagatttagaaacggccgtacgtaaaaatttaaatatcatccagcttatttggaatgatggaaaatataacatggttgaattccaagaagaaatgaaatataaacgttcgtcaggtgtagacttcggtcctgtagattttgtaaaatatgcagaatcatttggcgcgaaaggtttacgagttactaatcaagaagaattagaagcggcaattaaagagggctatgaaacagatggtccagtattaattgatatacctgtaaattacaaagataatatcaaactttcaacaaatatgttacctgacgtatttaactaa

SEQ ID NO: 8 - protein, 554 aa, Staphylococcus aureus
MTDKKYTAADMVIDTLKNNGVEYVFGIPGAKIDYLFNALIDDGPELIVTRHEQNAAMMAQGIGRLTGKPGVVLVTSGPGVSNLTTGLLTATSEGDPVLALGGQVKRNDLLRLTHQSIDNAALLKYSSKYSEEVQDPESLSEVMTNAIRIATSGKNGASFISIPQDVISSPVESKAISLCQKPNLGVPSEQDINDVIEAIKNASFPVLLAGMRSSSAEETNAIRKLVERTNLPVVETFQGAGVISRELENHFFGRVGLFRNQVGDELLRKSDLVVTIGYDPIEYEASNWNKELETQIINIDEVQAEITNYMQPKKELIGNIAKTIEMISEKVDEPFINQQHLDELEQLRTHIDEETGIKATHEEGILHPVEIIESMQKVLTDDTTVTVDVGSHYIWMARNFRSYNPRHLLFSNGMQTLGVALPWAISAALVRPNTQVVSVAGDGGFLFSSQDLETAVRKNLNIIQLIWNDGKYNMVEFQEEMKYKRSSGVDFGPVDFVKYAESFGAKGLRVTNQEELEAAIKEGYETDGPVLIDIPVNYKDNIKLSTNMLPDVFN

SEQ ID NO: 9 - DNA, 1698 bp, Listeria monocytogenes
  CDS (1)..(1698)
atggcgaaactagaaaaagaccaagaaaaagtaataacacaagggaaatcaggagcggatttagttgtagacagcttaattaatcaaggtgttacgcatgtattcgggattccgggagcgaaaattgataaagtttttgatgtgatggaagaacgtggaccagaattaattgtcagtcgtcatgaacaaaatgcggcgtttatggctgctgctatcggtcgtctaaccgggaaacctggtgttgtacttgtaactagtggacctggcgcatcgaatcttgcaacagggcttgtaaccgcaactgcagaaggagatccagtcgttgcgattgctggtaacgtaacaaggcaagaccgcttaaaaagaacccaccaatcaatggataatgcagcacttttccgtccgattacaaaatacagcgaagaagtagttcacgccgaaagtattccagaagcaatcactaacgcttttcgctcggcaacagaaccaaaccaaggcgctgcttttgtcagtttgccacaagatatcgtgaacgaaccaaacgtaccagtaaaagcgattcgcccacttgctaaaccagaaaatggtcctgcttccaaagaacaagttgcaaaacttgttacacgtttgaaaaaagcgaaattaccggtattgctattgggtatgcgagcatctagtccagaagtaactggtgcaattcgtcgcttactccaaaaaacaagtatcccagtagtagaaactttccaagcagctggcgtcatttcacgcgacttagaagataacttctttggacgtgttggtctgttccgcaaccaaccaggggatattttgttaaataaagctgatttagttattacagtgggttatgatccaattgaatacgatccaaaagcttggaatgcctctggtgatagaacgattgtccatttagacgacattcgcgctgatattgatcattattaccaaccagtgacagagctagtcggaaacatcgcgcttactttagaccgagtgaatgcgaaattcagcggtttagaattagcggaaaaagaacttgaaacattaaaagaacttcatgctcaattagaagagcgagatgttccgccagaaagtgatgaaactaaccgagtacatccattgtcggtcattcaaacactacgttcggcaattgatgacaacgtaactgtgacagtcgacgttggttcacattatatttggatggcacgtcatttccgctcctatgaaccacgccgtctgcttttcagtaacggtatgcaaacgcttggtgttgcgcttccttggggaattgctgcaacacttgtacatccgggtgaaaaagtggtttcgatttctggtgacggtggtttcttattttccgcgatggaattagaaacagctgtccgcttgcgtgcgccacttgtacacctagtatggaatgacggaagctatgacatggttgctttccaacaaaaaatgaaatacggcaaagaagcagctgttcgttttggcgatgttgatatcgtaaaatttgcagaaagtttcggagcaaaaggtcttcgcgtaacaaatccagcagaactttctgatgtgttaaaagaagcgcttgaaacagaaggacccgtcgttgtagatattccaattgattaccgtgataacatcaaacttggcgaaactttactacctgaccaattttattaa

SEQ ID NO: 10 - protein, 565 aa, Listeria monocytogenes
MAKLEKDQEKVITQGKSGADLVVDSLINQGVTHVFGIPGAKIDKVFDVMEERGPELIVSRHEQNAAFMAAAIGRLTGKPGVVLVTSGPGASNLATGLVTATAEGDPVVAIAGNVTRQDRLKRTHQSMDNAALFRPITKYSEEVVHAESIPEAITNAFRSATEPNQGAAFVSLPQDIVNEPNVPVKAIRPLAKPENGPASKEQVAKLVTRLKKAKLPVLLLGMRASSPEVTGAIRRLLQKTSIPVVETFQAAGVISRDLEDNFFGRVGLFRNQPGDILLNKADLVITVGYDPIEYDPKAWNASGDRTIVHLDDIRADIDHYYQPVTELVGNIALTLDRVNAKFSGLELAEKELETLKELHAQLEERDVPPESDETNRVHPLSVIQTLRSAIDDNVTVTVDVGSHYIWMARHFRSYEPRRLLFSNGMQTLGVALPWGIAATLVHPGEKVVSISGDGGFLFSAMELETAVRLRAPLVHLVWNDGSYDMVAFQQKMKYGKEAAVRFGDVDIVKFAESFGAKGLRVTNPAELSDVLKEALETEGPVVVDIPIDYRDNIKLGETLLPDQFY

SEQ ID NO: 11 - DNA, 1680 bp, Streptococcus mutans
  CDS (1)..(1680)
atgaccgaaataaataaggaaggctatggggctgacctgattgtagacagcctcattaatcatgatgtcaactatgtttttggaatccctggtgcaaaaattgatcgtgtctttgataccttagaagataaggggccagaacttattgtagcacgccatgagcaaaatgctgcttttatggctcaaggaattggccgtattactggtgagcctggtgttgtgattacaaccagcggtcccggtgtttccaatctggtgactggtcttgttactgcgacagctgagggagatcctgtccttgctattggtggtcaggttaaacgtgctgatttgctcaaacgggctcaccagtcaatgaataatgttgctatgctcgatcccattaccaaatattcagcagaaattcaggatcccgcaacactttcagaaaatattgctaatgcctatcgtttggctaaagcaggaaagccgggagctagtttcttatctattcctcaagatataactgatagtcctgttactgtcaaggcgattaagcccttgacagatcctaaactaggttcagcgtcagttgctgatattaattatttggcacaggccataaaaaatgcggtccttcctgtcttacttttaggaaatggtgcgtcaacggctgcagttacagcttctattcgccgtttgttaggagctgtcaagctgccagtcgttgaaactttccaaggagctggtattgtttcaagagatttagaagaggacactttttttggtcgtgtggggctttttcgtaatcagcccggagatatgttgctgaagcgttctgacttagttatcgctattggctatgatcctattgaatatgaagcgcgcaattggaatgctgaaatttcggctcgcattatcgttattgatgttgctccagctgaaattgatacttatttccaacctgaacgtgaattaattggtgatatagctgaaacacttgatttactcctacctgctattagtggctactcacttccaaaaggttctcttgactatctcaaaggccttcgtgataatgtagtagaagatgtcaaatttgataagacagtcaaatccggtctggttcatccgcttgatgtgattgatgtccttcaaaagcaaacgactgatgatatgacagtaacggttgatgttggcagccattatatttggatggctcgttattttaaaagctatgaagcacggcacttacttttctcaaatggtatgcaaaccttaggtgttgctttgccttgggcaatttcggcagctcttgtacggccaaatgagaagattatttctatttcaggtgatggtggtttcctcttttctggccaagaattggaaacagctgttcgtttacatttaccaattgttcatatcatttggaatgatggtaaatataatatggttgaattccaagaagaaatgaaatacggccgttcagcaggtgttgattttggtcctgttgattttgtcaagtatgctgatagtttcggtgctaaaggttaccgtgctgatagtaaagaaaagtttgatcaagttcttcaaacagcactcaaggaagctgcaaatggcccagttctcattgatgttccaatggactataaagataatgtaaaattgggtgaaactattttgcctgatgaattctactaa

SEQ ID NO: 12 - protein, 559 aa, Streptococcus mutans
MTEINKEGYGADLIVDSLINHDVNYVFGIPGAKIDRVFDTLEDKGPELIVARHEQNAAFMAQGIGRITGEPGVVITTSGPGVSNLVTGLVTATAEGDPVLAIGGQVKRADLLKRAHQSMNNVAMLDPITKYSAEIQDPATLSENIANAYRLAKAGKPGASFLSIPQDITDSPVTVKAIKPLTDPKLGSASVADINYLAQAIKNAVLPVLLLGNGASTAAVTASIRRLLGAVKLPVVETFQGAGIVSRDLEEDTFFGRVGLFRNQPGDMLLKRSDLVIAIGYDPIEYEARNWNAEISARIIVIDVAPAEIDTYFQPERELIGDIAETLDLLLPAISGYSLPKGSLDYLKGLRDNVVEDVKFDKTVKSGLVHPLDVIDVLQKQTTDDMTVTVDVGSHYIWMARYFKSYEARHLLFSNGMQTLGVALPWAISAALVRPNEKIISISGDGGFLFSGQELETAVRLHLPIVHIIWNDGKYNMVEFQEEMKYGRSAGVDFGPVDFVKYADSFGAKGYRADSKEKFDQVLQTALKEAANGPVLIDVPMDYKDNVKLGETILPDEFY

SEQ ID NO: 13 - DNA, 1683 bp, Streptococcus thermophilus
  CDS (1)..(1683)
gtgttcatgtcagaagaaaagcaattgtatggtgcagatttagtggttgatagtttgatcaaccatgatgttgagtatgtctttgggattccaggcgcaaaaatcgatagggtttttgataccttggaagataagggacctgaattgattgttgcccgtcatgagcaaaatgctgcttttatggctcaaggtgttggacgtattactgggaaaccaggtgtagtattggtaacatctggtccaggtgtctccaatttggctactggtttggtaacagcgacggatgaaggagaccctgttcttgctattggtggtcaggttaagcgtgcagatctcttgaaacgtgcccaccaatcaatgaataacgttgctatgcttgagccaattaccaaatatgctgctgaagtacatgatgctaacaccctttctgaaacggttgctaatgcctatcgtcacgctaagtcagggaaaccaggtgcaagcttcatttcaattcctcaagacgtgacggatgctccggtcagtgttaaggctattaagcctatgacagatccaaaacttggttcagcatctgtttctgatattaactatctagcacaagccattaaaaatgcagtgttgccagtctttcttttggggaatggtgcctcatcagaagccgtaacttactctattcgccaaattttgaagcatgttaaattgccagttgttgaaactttccaaggtgccggtatcgtgtcacgtgaccttgaagaagatactttctttggtcgtgtaggtcttttccgtaaccaacccggagacatgttgcttaaaaaatccgacttagttattgccattggttatgatccaatcgaatatgaagcacgtaactggaatgctgaaatttcagcacgtatcatcgttattgatgtcgagccggccgaggtggacacttacttccaaccggaacgtgaattgattggtaatgtagaagcgagcttagacttgcttttgcccgctattcaaggttataaattgcctgaaggtgcggttgaatatcttaaaggtttgaaaaacaatgttgttgaggatgttaagtttgaccgtcagcctgatgaaggtacggtgcatccgctagatttcatcgaaaatttgcaagaacacacagatgatgatatgactgttacgtttgatgttggtagtcactatatttggatggcacgttatctcaaatcgtatgaaccacgtcatttgcttttctcaaatgggatgcaaacgataggtattgctattacatgggctatctctgcagcattggttcgtcctaagacaaaagtgatttctgtatctggtgatggtggtttcctcttctcagcacaagaattggaaacagcagttcgtttgaaattgccaattgtccatattatctggaacgatggtcattacaatatggtggaattccaggaagaaatgaagtacggtcgttcatctggggttgactttggtcctgtagattttgtaaaatatgctgagagctttggagccaaaggttatcgtgcaacaagtaaagcagcgtttgctagcttgcttcaagaggctttgactcaggctgtagatggaccagtccttattgatgttccaattgactataaagataacattaaactcggcgaaactattttgccagatgaattttactaa

SEQ ID NO: 14 - protein, 560 aa, Streptococcus thermophilus
VFMSEEKQLYGADLVVDSLINHDVEYVFGIPGAKIDRVFDTLEDKGPELIVARHEQNAAFMAQGVGRITGKPGVVLVTSGPGVSNLATGLVTATDEGDPVLAIGGQVKRADLLKRAHQSMNNVAMLEPITKYAAEVHDANTLSETVANAYRHAKSGKPGASFISIPQDVTDAPVSVKAIKPMTDPKLGSASVSDINYLAQAIKNAVLPVFLLGNGASSEAVTYSIRQILKHVKLPVVETFQGAGIVSRDLEEDTFFGRVGLFRNQPGDMLLKKSDLVIAIGYDPIEYEARNWNAEISARIIVIDVEPAEVDTYFQPERELIGNVEASLDLLLPAIQGYKLPEGAVEYLKGLKNNVVEDVKFDRQPDEGTVHPLDFIENLQEHTDDDMTVTFDVGSHYIWMARYLKSYEPRHLLFSNGMQTIGIAITWAISAALVRPKTKVISVSGDGGFLFSAQELETAVRLKLPIVHIIWNDGHYNMVEFQEEMKYGRSSGVDFGPVDFVKYAESFGAKGYRATSKAAFASLLQEALTQAVDGPVLIDVPIDYKDNIKLGETILPDEFY

SEQ ID NO: 15 - DNA, 1665 bp, Vibrio angustum
  CDS (1)..(1665)
atgtcggataaaaccgtctctggtgctgaactggttgttgaaactttaaatgcacataacgttccacacatttttggtattcctggagcaaaggtggatgctgttttcgatgctgtttgtgataacggaccagaaatcattatttgtcatcatgaacaaaatgcagcgtttatggcagcagcaactgggcgtttaacgggtaaagcaggcatttgtttagcaacctctggaccaggcgcatcaaaccttgtcacaggcgttgcaacagcgaatagtgaaggtgatcctgtggttgcacttgcaggtgctgtacctctttctatgtattctcacaatactcatcaatccatggatacccgttcactgtttactcctatcaccaagttttcagcagaagtgatggatagcagctcggtatctgatgttgtacataaagcttttcgtattgcagagcaacctacccaaggtgctagctttgttagtctaccgcaagatattctaactaaccgtattccttaccagccagtacaacagcctaatccaattttgttcggtggtgcacacccacaagctattcgtcaggctgctgatcgcattaatgctgcaaaaaatccggtgttattactgggcatggatgcaagccagccttttgttgctgatgctattcgccaactactcaaacaaacaccaattgccgttgtgaatacgtttgccgcagctggggttatttctcatgatttatacaactgctttttaggtcgtgttggcttatttaaaaatcaacccggtgatattgcattaaacagtgcagatttaatcattaccattggctacagcccaattgaatacgatccgattctttggaataaagatgcaaacacaccaattattcatattggttatcaacaagcagatttagaaattagctataaccctgtttgtgaagttgtgggtgacttagcggtgtctgtcacgtctattgcttctgaattagataagcgagaatcattagaaaataaccaacaaatccaattattacgccacgatttacaacatattatgcagatgggggtaaataaaacctcaacaaacggcgttcacccgcttcgttttgttcatgagttacgtcgctttgttagtgacgacaccactgtatgttgtgatgtaggctctatttatatttggatggcacgttacttccacagctttgaacctcgtcgtttattgttcagcaatggccaacaaacattgggcgtagctttaccttgggcaattgcagcttcccttcttcaccctaatgaaaaagtaatttccatgtctggtgatggtggcttcctattctcatcaatggaattagccacggccgttcgccataaatgtaatatcgttcactttgtttggacagatcacagttatgacatggttaagatccaacagcttaaaaagtatggtcgagagagtgccgtcagctttataggtcctgatattgttaagtacgcagaaagcttcggcgcacatggtttagcgatcaatactgccgatgatattgagcctgttatgcgaaaagctatgagcttaagtggcccagtattggtcaacgtcaatgttgattatagcgataacagtcgcctacttgatcaacttcatccatgccaacaagattaa

SEQ ID NO: 16 - protein, 554 aa, Vibrio angustum
MSDKTVSGAELVVETLNAHNVPHIFGIPGAKVDAVFDAVCDNGPEIIICHHEQNAAFMAAATGRLTGKAGICLATSGPGASNLVTGVATANSEGDPVVALAGAVPLSMYSHNTHQSMDTRSLFTPITKFSAEVMDSSSVSDVVHKAFRIAEQPTQGASFVSLPQDILTNRIPYQPVQQPNPILFGGAHPQAIRQAADRINAAKNPVLLLGMDASQPFVADAIRQLLKQTPIAVVNTFAAAGVISHDLYNCFLGRVGLFKNQPGDIALNSADLIITIGYSPIEYDPILWNKDANTPIIHIGYQQADLEISYNPVCEVVGDLAVSVTSIASELDKRESLENNQQIQLLRHDLQHIMQMGVNKTSTNGVHPLRFVHELRRFVSDDTTVCCDVGSIYIWMARYFHSFEPRRLLFSNGQQTLGVALPWAIAASLLHPNEKVISMSGDGGFLFSSMELATAVRHKCNIVHFVWTDHSYDMVKIQQLKKYGRESAVSFIGPDIVKYAESFGAHGLAINTADDIEPVMRKAMSLSGPVLVNVNVDYSDNSRLLDQLHPCQQD

SEQ ID NO: 17 - DNA, 1689 bp, Bacillus cereus
ttgagtacaggtgtaaaagcaaacgacgtgaagacaaaaacaaaaggagcagatcttgttgttgattgtttaattaaacaaggtgttacacatgttttcggtattccaggagcaaagattgactctgtatttgatgtactgcaagaaagaggaccagagttaattgtttgtcgtcatgaacaaaatgcagcatttatggcagctgctattggtagattaacaggaaaaccgggcgtatgtcttgtaacttcaggaccagggacatcaaatttagcgacaggtcttgttactgcgaatgcggagagtgatcccgttgttgctttagctggtgcagttccgcgtacggatcgattaaaacgtacacatcaatctatggataatgctgcactattcgaaccaatcacaaaatatagcgtagaagtagagcatcctgataatgtgccagaagcattatcaaatgcattccgaagtgcgacttctacaaatccaggagcaactttagtaagtttgccgcaagacgttatgactgcggaaacgactgtagagtctatcggtgcgctttctaagccacagcttggaatcgctcccacacatgatattacatatgtagtagataaaataaaagcagcgaaattaccagttattttactcggtatgagagcgagcacaaatgaagtgacgaaagccgttcgtaaattaattgcggatacagaacttcctgtcgttgaaacatatcaagcggctggtgccatttcacgtgagttagaagatcatttcttcggccgtgttggactattccgtaaccaaccaggtgatattttactagaagaggcagatcttgttatttctatcggttatgatccaattgagtatgatccaaagttctggaataaacttggagacagaacgattattcatcttgatgaccatcaagcagatatagatcatgattaccaaccagagcgtgaattaattggtgatattgccttaacagtaaatagcatcgcagaaaagttaccgaaacttgtgttaagtacgaaatcagaagcagtgttagaacgattacgcgcgaaattatcagaacaagcagaagttccaaatcgtccttcagaaggtgttacacatccgcttcaagtgattcgtacacttcgttctttaattagtgacgacacaaccgttacatgtgacatcggttcccattctatttggatggcgagatgtttccgttcttatgaaccacgtagattattatttagtaacggtatgcagacgttaggtgttgcacttccttgggcaattgctgctactttagtagaaccaggtaaaaaagtagtttccgtatcaggtgacggtggtttcttattctcagcgatggagttagaaacggcggtacgtttaaattctccaatcgtccatcttgtttggagagacggcacatatgatatggttgcattccaacaaatgatgaaatacggcagaacatcagctacagagtttggtgatgttgatcttgttaaatatgcggaaagtttcggggcgttaggtcttcgtgttaacacgcctgatgaattagaaggggtattgaaagaagcactagcagcagacggccctgtcattattgatattccaattgactatcgtgacaacattaaattaagcgaaaaattattaccaaaccaattaaactaa

SEQ ID NO: 18 - protein, 562 aa, Bacillus cereus
MSTGVKANDVKTKTKGADLVVDCLIKQGVTHVFGIPGAKIDSVFDVLQERGPELIVCRHEQNAAFMAAAIGRLTGKPGVCLVTSGPGTSNLATGLVTANAESDPVVALAGAVPRTDRLKRTHQSMDNAALFEPITKYSVEVEHPDNVPEALSNAFRSATSTNPGATLVSLPQDVMTAETTVESIGALSKPQLGIAPTHDITYVVDKIKAAKLPVILLGMRASTNEVTKAVRKLIADTELPVVETYQAAGAISRELEDHFFGRVGLFRNQPGDILLEEADLVISIGYDPIEYDPKFWNKLGDRTIIHLDDHQADIDHDYQPERELIGDIALTVNSIAEKLPKLVLSTKSEAVLERLRAKLSEQAEVPNRPSEGVTHPLQVIRTLRSLISDDTTVTCDIGSHSIWMARCFRSYEPRRLLFSNGMQTLGVALPWAIAATLVEPGKKVVSVSGDGGFLFSAMELETAVRLNSPIVHLVWRDGTYDMVAFQQMMKYGRTSATEFGDVDLVKYAESFGALGLRVNTPDELEGVLKEALAADGPVIIDIPIDYRDNIKLSEKLLPNQLN

SEQ ID NO: 19 - DNA, 780 bp, Klebsiella pneumoniae
atgaatcattctgctgaatgcacctgcgaagagagtctatgcgaaaccctgcgggcgttttccgcgcagcatcccgagagcgtgctctatcagacatcgctcatgagcgccctgctgagcggggtttacgaaggcagcaccaccatcgcggacctgctgaaacacggcgatttcggcctcggcacctttaatgagctggacggggagctgatcgccttcagcagtcaggtctatcagctgcgcgccgacggcagcgcgcgcaaagcccagccggagcagaaaacgccgttcgcggtgatgacctggttccagccgcagtaccggaaaacctttgaccatccggtgagccgccagcagctgcacgaggtgatcgaccagcaaatcccctctgacaacctgttctgcgccctgcgcatcgacggccatttccgccatgcccatacccgcaccgtgccgcgccagacgccgccgtaccgggcgatgaccgacgtcctcgacgatcagccggtgttccgctttaaccagcgcgaaggggtgctggtcggcttccggaccccgcagcatatgcaggggatcaacgtcgccgggtatcacgagcactttattaccgatgaccgcaaaggcggcggtcacctgctggattaccagctcgaccatggggtgctgaccttcggcgaaattcacaagctgatgatcgacctgcccgccgacagcgcgttcctgcaggctaatctgcatcccgataatctcgatgccgccatccgttccgtagaaagttaa

SEQ ID NO: 20 - protein, 259 aa, Klebsiella pneumoniae
MNHSAECTCEESLCETLRAFSAQHPESVLYQTSLMSALLSGVYEGSTTIADLLKHGDFGLGTFNELDGELIAFSSQVYQLRADGSARKAQPEQKTPFAVMTWFQPQYRKTFDHPVSRQQLHEVIDQQIPSDNLFCALRIDGHFRHAHTRTVPRQTPPYRAMTDVLDDQPVFRFNQREGVLVGFRTPQHMQGINVAGYHEHFITDDRKGGGHLLDYQLDHGVLTFGEIHKLMIDLPADSAFLQANLHPDNLDAAIRSVES

SEQ ID NO: 21 - DNA, 768 bp, Bacillus subtilis
atgaaacgagaaagcaacattcaagtgctcagccgtggtcaaaaagatcagcctgtgagccagatttatcaagtatcaacaatgacttctctattagacggagtatatgacggagattttgaactgtcagagattccgaaatatggagacttcggtatcggaacctttaacaagcttgacggagagctgattgggtttgacggcgaattttaccgtcttcgctcagacggaaccgcgacaccggtccaaaatggagaccgttcaccgttctgttcatttacgttctttacaccggacatgacgcacaaaattgatgcgaaaatgacacgcgaagactttgaaaaagagatcaacagcatgctgccaagcagaaacttattttatgcaattcgcattgacggattgtttaaaaaggtgcagacaagaacagtagaacttcaagaaaaaccttacgtgccaatggttgaagcggtcaaaacacagccgattttcaacttcgacaacgtgagaggaacgattgtaggtttcttgacaccagcttatgcaaacggaatcgccgtttctggctatcacctgcacttcattgacgaaggacgcaattcaggcggacacgtttttgactatgtgcttgaggattgcacggttacgatttctcaaaaaatgaacatgaatctcagacttccgaacacagcggatttctttaatgcgaatctggataaccctgattttgcgaaagatatcgaaacaactgaaggaagccctgaataa

SEQ ID NO: 22 - protein, 255 aa, Bacillus subtilis
MKRESNIQVLSRGQKDQPVSQIYQVSTMTSLLDGVYDGDFELSEIPKYGDFGIGTFNKLDGELIGFDGEFYRLRSDGTATPVQNGDRSPFCSFTFFTPDMTHKIDAKMTREDFEKEINSMLPSRNLFYAIRIDGLFKKVQTRTVELQEKPYVPMVEAVKTQPIFNFDNVRGTIVGFLTPAYANGIAVSGYHLHFIDEGRNSGGHVFDYVLEDCTVTISQKMNMNLRLPNTADFFNANLDNPDFAKDIETTEGSPE

SEQ ID NO: 23 - DNA, 780 bp, Klebsiella terrigena
gtgaatcattatcctgaatgcacctgccaggagagcctgtgcgaaaccgtacgcggcttctccgcccaccaccctgatagcgttatctatcagacctctctgatgagcgcgctgctgagcggggtctatgagggtagcaccaccatcgccgacctgctgacccacggcgacttcggtctcggcacctttaacgaactcgatggcgaactgattgcctttagcagcgaggtctaccagctgcgcgctgacggcagcgcgcgtaaagcccgggcggatcaaaaaacgcccttcgcggtgatgacctggttcagaccgcagtaccgtaaaacctttgaccacccggtcagccgccagcagctgcacgacgttatcgaccagcaaatcccctccgataacctgttctgcgccctgcatattgatggtcactttcgccacgcccacacccgcaccgtgccgcggcagacgccgccctatcgggcgatgaccgacgtgctcgatgaccagccggttttccgcttcaaccagcgcaaggggacgctggtcggctttcgcaccccgcagcatatgcagggccttaacgttgccggctaccacgagcactttattaccgacgatcgccagggcggcggccatctgctggactaccagctcgatagcggcgtgctgaccttcggcgagatccacaagctgatgattgacctcccggccgacagcgctttcctgcaggccgacctgcatcctgacaatctcgatgccgctattcgtgcggtagaaaactaa

SEQ ID NO: 24 - protein, 259 aa, Klebsiella terrigena
MNHYPECTCQESLCETVRGFSAHHPDSVIYQTSLMSALLSGVYEGSTTIADLLTHGDFGLGTFNELDGELIAFSSEVYQLRADGSARKARADQKTPFAVMTWFRPQYRKTFDHPVSRQQLHDVIDQQIPSDNLFCALHIDGHFRHAHTRTVPRQTPPYRAMTDVLDDQPVFRFNQRKGTLVGFRTPQHMQGLNVAGYHEHFITDDRQGGGHLLDYQLDSGVLTFGEIHKLMIDLPADSAFLQADLHPDNLDAAIRAVEN

SEQ ID NO: 25 - DNA, 771 bp, Klebsiella pneumoniae
atgaaaaaagtcgcacttgttaccggcgccggccaggggattggtaaagctatcgcccttcgtctggtgaaggatggatttgccgtggccattgccgattataacgacgccaccgccaaagcggtcgcctcggaaatcaaccaggccggcggacacgccgtggcggtgaaagtggatgtctccgaccgcgatcaggtatttgccgccgttgaacaggcgcgcaaaacgctgggcggcttcgacgtcatcgtcaataacgccggtgtggcaccgtctacgccgatcgagtccattaccccggagattgtcgacaaagtctacaacatcaacgtcaaaggggtgatctggggtattcaggcggcggtcgaggcctttaagaaagaggggcacggcgggaaaatcatcaacgcctgttcccaggccggccacgtcggcaacccggagctggcggtgtatagctccagtaaattcgcggtacgcggcttaacccagaccgccgctcgcgacctcgcgccgctgggcatcacggtcaacggctactgcccggggattgtcaaaacgccaatgtgggccgaaattgaccgccaggtgtccgaagccgccggtaaaccgctgggctacggtaccgccgagttcgccaaacgcatcactctcggtcgtctgtccgagccggaagatgtcgccgcctgcgtctcctatcttgccagcccggattctgattacatgaccggtcagtcgttgctgatcgacggcgggatggtatttaactaa

SEQ ID NO: 26 - protein, 256 aa, Klebsiella pneumoniae
MKKVALVTGAGQGIGKAIALRLVKDGFAVAIADYNDATAKAVASEINQAGGHAVAVKVDVSDRDQVFAAVEQARKTLGGFDVIVNNAGVAPSTPIESITPEIVDKVYNINVKGVIWGIQAAVEAFKKEGHGGKIINACSQAGHVGNPELAVYSSSKFAVRGLTQTAARDLAPLGITVNGYCPGIVKTPMWAEIDRQVSEAAGKPLGYGTAEFAKRITLGRLSEPEDVAACVSYLASPDSDYMTGQSLLIDGGMVFN

SEQ ID NO: 27 - DNA, 1053 bp, Bacillus cereus
atgaaagcactactttggcataatcaacgtgatgtacgagtagaagaagtaccagaaccaacagtaaaaccaggaacagtgaaaatcaaagttaaatggtgtggtatttgtgggacagacttgcatgaatatttagcagggcctatttttattccaacagaagaacatccattaacacatgtgaaagcacctgttattttaggtcatgagtttagtggtgaggtaatagagattggtgaaggagttacatctcataaagtgggagaccgcgttgttgtagagccaatttattcttgtggtaaatgtgaagcttgtaaacatggacattacaatgtttgtgaacaacttgttttccacggtcttggcggagaaggcggcggtttctctgaatatacagtagtaccagaagatatggttcatcacattccagatgaaatgacgtatgaacaaggtgcgcttgtagaaccagcagcagtagcagttcatgcagtacgtcaaagtaaattaaaagaaggggaagctgtagcggtatttggttgcggtccaattggacttcttgttatccaagcagctaaagcagcaggagcaactcctgttattgcagttgaactttctaaagaacgtcaagagttagcgaaattagcaggtgcggattatgtattaaatccagcaactcaagatgtgttagctgaaattcgtaacttaacaaatggtttaggtgtaaatgttagctttgaagtaacaggtgttgaagttgtactacgccaagcgattgaaagtacaagcttcgaaggacaaactgtaattgttagtgtatgggaaaaagacgcaacaattactccaaataacttagtattaaaagaaaaagaagttattggtattttaggataccgtcacatcttcccagctgttattaaattgattagctccggtcaaattcaagcagagaaattaattacgaaaaaaattacagtggatcaagttgttgaagaaggatttgaagcacttgtaaaagataaaacacaagtgaaaattcttgtttcacctaaataa

SEQ ID NO: 28 - protein, 350 aa, Bacillus cereus
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSPK

SEQ ID NO: 29 - DNA, 1113 bp, Lactococcus lactis
ttgcctgaaacgacaaccatcctatatagaggaggcgtttttatgcgcgcagcacgtttttacgaccgcggggatatccgcattgatgaaattaatgaaccaatagtaaaagctggccaagttggcattgatgtggcttggtgtggaatttgtggaacagatctccatgaatttttagatggcccaattttttgtccgtcagcagaacatcctaatccaattactggagaagtaccaccagtcactcttggacatgaaatgtctggggttgtaaattttataggtgaaggagtaagcggacttaaagtaggtgaccatgtcgttgtcgaaccttatatcgttcccgaagggactgatacaagtgaaactggacattataacctctcagaaggctcaaactttattggtttgggcggaaatggtggaggtttggctgaaaaaatttctgttgatgaacgttgggttcacaaaattcctgataacttaccattggatgaagctgctctaattgagccactatcagtcggctatcacgctgttgaacgagcaaatttaagtgaaaagagtacggtattagttgttggtgctggaccaattggactattaactgctgccgttgcaaaagcgcaaggacatactgttatcatcagtgaacctagtggacttcgtcgtaaaaaagcacaagaagcacaagttgctgattatttcttcaatccaattgaagatgacattcaagctaaagttcatgaaattaatgaaaaaggagtggacgcagcctttgaatgtacctctgtccaaccgggatttgacgcttgtctagatgcgattcgtatgggtggaacagttgtcattgtcgcaatttggggcaagcctgctagtgttgatatggcaaaattagtaatcaaagaagctaaccttttaggaacgattgcttataataacactcatccaaaaacaattgatttagtatcaacaggtaaaataaaattggaccaattcatcacagctaaaatcggtttggatgatttgattgataaaggattcgatacgctgattcatcataatgaaacagctgttaaaattttagtttcaccaactggtaaaggtctataa

SEQ ID NO: 30 - protein, 370 aa, Lactococcus lactis
MPETTTILYRGGVFMRAARFYDRGDIRIDEINEPIVKAGQVGIDVAWCGICGTDLHEFLDGPIFCPSAEHPNPITGEVPPVTLGHEMSGVVNFIGEGVSGLKVGDHVVVEPYIVPEGTDTSETGHYNLSEGSNFIGLGGNGGGLAEKISVDERWVHKIPDNLPLDEAALIEPLSVGYHAVERANLSEKSTVLVVGAGPIGLLTAAVAKAQGHTVIISEPSGLRRKKAQEAQVADYFFNPIEDDIQAKVHEINEKGVDAAFECTSVQPGFDACLDAIRMGGTVVIVAIWGKPASVDMAKLVIKEANLLGTIAYNNTHPKTIDLVSTGKIKLDQFITAKIGLDDLIDKGFDTLIHHNETAVKILVSPTGKGL

SEQ ID NO: 31 - DNA, 2532 bp, Roseburia inulinivorans
atgggcaattacgattcaacaccgatagctaaaagtgataggattaaaagattggttgatcatttgtatgctaaaatgcctgaaattgaggccgctagagcagagctaattactgaatcctttaaggccaccgaaggtcaacctgttgttatgagaaaggctagagcttttgaacatatactaaagaatttgccaattatcataagaccagaagaactgattgttggctcaactacaattgcccctagaggttgccaaacgtatccagaattctcatacgagtggttagaggctgaatttgaaactgtcgaaacgcgttcagctgacccattttatatttcagaagaaacgaagaaacgtttgctggctgccgatgcttattggaaaggtaaaacaacctcagagttggcaacttcatatatggccccagaaactctaagagccatgaagcataacttcttcacccctggaaactacttctacaatggtgtcggtcatgtcacagttcaatatgaaacagtattagcaatcggcttgaatggagtaaaagagaaggttaggaaagagatggagaattgtcattttggtgatgccgattatagtacaaagatgtgtttcttggagagcattttaatatcgtgtgatgccgtaatcacttatgctaatagatatgccaagatggccgaggaaatggctgaaaaagaaacagatgctgcaaggaggcaagaactattaacaatcgccagggtttgcaaaaacgttcctgaattcccagccgaaagcttccaggaggcctgccaatccttttggttcatacaacaagtgcttcaaattgaatccagtggtcattcaatttccccaggtagatttgatcaatatatgtatccttattacgaaaaggatttaaaggaaggtagcttaactagggaatatgctcaggaactgatcgattgtatctgggttaagttaaatgatctgaataagtgcagggatgctgcctctgctgagggctttgcaggatattccttatttcaaaacttaatcgttgggggccaaacggttcaaggaagggacgccaccaatgatttgagttttatgtgtatcacggcatctgaacacgtctttttaccgatgccgtcgttgtctataagagtttggcatggtagttccaaagcactgcttatgagagcagctgaattgactagaaccggtataggcttacctgcttattacaatgatgaagtcatcataccagctttggtgcataggggtgctactatggatgaagcaagaaattacaacataataggatgtgtcgaaccgcaggttcctggtaaaactgatggctggcacgatgcagcattctttaacatgtgcagacctttggaaatggtgtttagtaatggttatgataacggtgaaattgcatctatacaaactggtaacgtagaatcttttcagagttttgatgagtttatggaagcttacagaaaacaaatgctatataacatagaacttatggtaaatgccgacaacgcgatagattatgcccacgcaaagttggccccattgccatttgagtcatgtttggttgatgactgtataaagagaggaatgtccgctcaggaaggcggcgcaatctataatttcactggtccacagggctttggtattgcaaacgttgctgatagcttgtatacgattaagaaattggtgttcgaggagaagagaattacgatgggtgaattaaagaaagcgttggaaatgaattatggtaagggtttggatgccacaaccgctggtgacatcgcaatgcaggtcgcgaagggactaaaagatgccggacaggaagtgggtcccgacgtgatcgctaatacaatccgtcaagttcttgaaatggaattaccagaagatgtaagaaagagatatgaagagatccatgaaatgatacttgagttaccaaagtatggtaatgatatagatgaagttgatgaattagctagagaagcagcttacttttacacaagaccattagaaacttttaagaatccaaggggtggcatgtatcaagccggcctttatcccgtgtccgctaatgtgccactaggcgctcaaacgggggccacacccgatggacgtttggcgcatacacccgtggcggatggcgttggtccgacatcaggcttcgatatatccggaccaacagcttcttgcaattctgtcgccaagttggatcatgctatagcctctaatggtaccttatttaatatgaagatgcacccaaccgcaatggcaggtgaaaagggcttagaatccttcatatcgttgatccgtggttatttcgatcaacaaggtatgcacatgcaatttaacgtagtagacagggctacactgcttgatgcgcaggcccaccctgaaaagtattcaggcttaattgtcagagtggcaggttattctgccctttttaccacattgtccaagtcattacaagatgatataatcaaacgtaccgaacaagcagacaatagatag

SEQ ID NO: 32 - protein, 843 aa, Roseburia inulinivorans
MGNYDSTPIAKSDRIKRLVDHLYAKMPEIEAARAELITESFKATEGQPVVMRKARAFEHILKNLPIIIRPEELIVGSTTIAPRGCQTYPEFSYEWLEAEFETVETRSADPFYISEETKKRLLAADAYWKGKTTSELATSYMAPETLRAMKHNFFTPGNYFYNGVGHVTVQYETVLAIGLNGVKEKVRKEMENCHFGDADYSTKMCFLESILISCDAVITYANRYAKMAEEMAEKETDAARRQELLTIARVCKNVPEFPAESFQEACQSFWFIQQVLQIESSGHSISPGRFDQYMYPYYEKDLKEGSLTREYAQELIDCIWVKLNDLNKCRDAASAEGFAGYSLFQNLIVGGQTVQGRDATNDLSFMCITASEHVFLPMPSLSIRVWHGSSKALLMRAAELTRTGIGLPAYYNDEVIIPALVHRGATMDEARNYNIIGCVEPQVPGKTDGWHDAAFFNMCRPLEMVFSNGYDNGEIASIQTGNVESFQSFDEFMEAYRKQMLYNIELMVNADNAIDYAHAKLAPLPFESCLVDDCIKRGMSAQEGGAIYNFTGPQGFGIANVADSLYTIKKLVFEEKRITMGELKKALEMNYGKGLDATTAGDIAMQVAKGLKDAGQEVGPDVIANTIRQVLEMELPEDVRKRYEEIHEMILELPKYGNDIDEVDELAREAAYFYTRPLETFKNPRGGMYQAGLYPVSANVPLGAQTGATPDGRLAHTPVADGVGPTSGFDISGPTASCNSVAKLDHAIASNGTLFNMKMHPTAMAGEKGLESFISLIRGYFDQQGMHMQFNVVDRATLLDAQAHPEKYSGLIVRVAGYSALFTTLSKSLQDDIIKRTEQADNR

SEQ ID NO: 33 - DNA, 794 bp, Roseburia inulinivorans
atgaaagaatatcttaatacttcaggtagaatatttgatatccagaggtattctattcacgatggccctggtgtgcgtacaattgtgtttctaaaaggttgtgcccttagatgcagatggtgctgtaatcctgaaagccaaagcttcgaagttgaaacaatgacgattaatggaaaacctaaagtcatgggtaaagatgttacagtcgccgaggttatgaagacggtagaaagagacatgccttattaccttcaatcaggtggtggtatcaccttatcgggtggcgaatgtactttgcaaccagaattttcccttggcctattgagagctgcaaaggatttgggcatatccacggcaatagagagcatggcgtacgcaaagtacgaagtaatagaaactcttcttccgtatttggatacgtatttaatggacatcaaacatatgaatcctgagaaacataaagaatacactggtcatgataacttgaggatgttagaaaacgccttaagagtcgcgcattctggtcagaccgaactgatcatcagagtacctgtcatcccaggattcaacgcaactgagcaggaactactagatattgcaaaattcgcagatacactgcctggagttagacaaatacacatcttgccatatcataattttggtcagggtaaatacgaaggattgaacagggactatccgatgggggacactgagaaaccctctaatgaacagatgaaagcttttcaagaaatgattcaaaagaacacttccctacattgccaaatcggtggtta

SEQ ID NO: 34 - protein, 264 aa, roseburia inulinivorans
MKEYLNTSGRIFDIQRYSIHDGPGVRTIVFLKGCALRCRWCCNPESQSFEVETMTINGKPKVMGKDVTVAEVMKTVERDMPYYLQSGGGITLSGGECTLQPEFSLGLLRAAKDLGISTAIESMAYAKYEVIETLLPYLDTYLMDIKHMNPEKHKEYTGHDNLRMLENALRVAHSGQTELIIRVPVIPGFNATEQELLDIAKFADTLPGVRQIHILPYHNFGQGKYEGLNRDYPMGDTEKPSNEQMKAFQEMIQKNTSLHCQIGG

SEQ ID NO: 35 - DNA, 1047 bp, Achromobacter xylosoxidans
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 36 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 37 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 38 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 39 - DNA, 1485 bp, Vibrio cholerae
atggcgaattatttcaatacgctgaatctgcgtgaacagttggatcaacttggtcgttgccgttttatggcgcgagaagagtttgcaaccgaagctgattacctaaaaggtaagaaagtggtgatcgtaggttgtggggctcaaggcctaaaccaaggcctcaatatgcgtgattcaggtttggatgtttcttacgctctgcgtcaggctgcgattgatgaacagcgtcagtcatttaagaatgccaagaataatggcttcaacgtgggtagttatgaacaactcatcccaaccgcagatttggtgattaacttgacgccagacaagcagcacaccagtgtggtcaatgcggtgatgcctctgatgaagcaaggtgctgccttgggttactcacacggttttaatatcgttgaagagggcatgcagatccgtaaagacatcacggttgtgatggtggcaccaaaatgtccgggtacggaagttcgtgaagagtataagcgcggtttcggcgttcctactcttatcgcggtacaccctgaaaacgatccacaaggtgaaggttgggaaattgctaaagcgtgggctgcggcaacgggtggccatcgtgcgggctgtttagcttcttcttttgtggcggaagtgaaatccgatttgatgggtgagcaaaccattctctgcggtatgctgcaagcgggctctatcgtttgttacgagaaaatggttgctgatggcatcgaccctggttatgcgggcaagcttttgcaatttggttgggaaaccattaccgaagcactcaagtttggcggtattactcatatgatggatcgcctgtctaaccctgcaaaaatcaaagcgtttgagctgtctgaagagttgaaagatctgatgcgcccactgtacaacaagcatatggatgacatcatttctggccacttctctagcaccatgatggcggattgggcgaatgatgataaagacttattcggctggcgtgcagaaaccgctgagacgacctttgaaaactatccaacaaccgacgtaaaaattgctgagcaagaatactttgataacggtattttgatgattgccatggtgcgtgctggggttgagttggcgtttgaagcgatgacggcttcaggcatcatcgatgagtcggcttactatgaatcactgcacgaactcccactgattgccaatacggtagcgcgtaagcgtctgtatgaaatgaacgtggtaatctctgacactgctgagtacggtaactatctgtttgccaatgtggcggtaccactattgcgtgaaaagtttatgccgaaagtgggcactgatgtgattggtaaaggattaggcgtggtctctaatcaagttgataacgcaacgcttatcgaagtaaacagcatcatccgtaaccatccggttgagtatatcggtgaagagctacgcggttacatgaaagacatgaagcgcatcgccgtgggtgattaa

SEQ ID NO: 40 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETTFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 41 - DNA, 1014 bp, Pseudomonas
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 42 - protein, 338 aa, Pseudomonas
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 43 - DNA, 1014 bp, Pseudomonas fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 44 - protein, 338 aa, Pseudomonas
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 45 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 46 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 47 - DNA, 1662 bp, Lactococcus lactis
tctagacatatgtatactgtgggggattacctgctggatcgcctgcacgaactggggattgaagaaattttcggtgtgccaggcgattataacctgcagttcctggaccagattatctcgcacaaagatatgaagtgggtcggtaacgccaacgaactgaacgcgagctatatggcagatggttatgcccgtaccaaaaaagctgctgcgtttctgacgacctttggcgttggcgaactgagcgccgtcaacggactggcaggaagctacgccgagaacctgccagttgtcgaaattgttgggtcgcctacttctaaggttcagaatgaaggcaaatttgtgcaccatactctggctgatggggattttaaacattttatgaaaatgcatgaaccggttactgcggcccgcacgctgctgacagcagagaatgctacggttgagatcgaccgcgtcctgtctgcgctgctgaaagagcgcaagccggtatatatcaatctgcctgtcgatgttgccgcagcgaaagccgaaaagccgtcgctgccactgaaaaaagaaaacagcacctccaatacatcggaccaggaaattctgaataaaatccaggaatcactgaagaatgcgaagaaaccgatcgtcatcaccggacatgagatcatctcttttggcctggaaaaaacggtcacgcagttcatttctaagaccaaactgcctatcaccaccctgaacttcggcaaatctagcgtcgatgaagcgctgccgagttttctgggtatctataatggtaccctgtccgaaccgaacctgaaagaattcgtcgaaagcgcggactttatcctgatgctgggcgtgaaactgacggatagctccacaggcgcatttacccaccatctgaacgagaataaaatgatttccctgaatatcgacgaaggcaaaatctttaacgagcgcatccagaacttcgattttgaatctctgattagttcgctgctggatctgtccgaaattgagtataaaggtaaatatattgataaaaaacaggaggattttgtgccgtctaatgcgctgctgagtcaggatcgtctgtggcaagccgtagaaaacctgacacagtctaatgaaacgattgttgcggaacagggaacttcatttttcggcgcctcatccatttttctgaaatccaaaagccatttcattggccaaccgctgtgggggagtattggttatacctttccggcggcgctgggttcacagattgcagataaggaatcacgccatctgctgtttattggtgacggcagcctgcagctgactgtccaggaactggggctggcgatccgtgaaaaaatcaatccgatttgctttatcatcaataacgacggctacaccgtcgaacgcgaaattcatggaccgaatcaaagttacaatgacatcccgatgtggaactatagcaaactgccggaatcctttggcgcgacagaggatcgcgtggtgagtaaaattgtgcgtacggaaaacgaatttgtgtcggttatgaaagaagcgcaggctgacccgaatcgcatgtattggattgaactgatcctggcaaaagaaggcgcaccgaaagttctgaaaaagatggggaaactgtttgcggagcaaaataaaagctaaggatcc

SEQ ID NO: 48 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 49 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 50 - DNA, 1692 bp, Saccharomyces cerevisiae
  CDS (1)..(1692)
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 51 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 52 - DNA, 1692 bp, Saccharomyces cerevisiaee
  CDS (1)..(1692)
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 53 - protein, 563 aa, Saccharomyces cerevisiaee
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 54 - DNA, 1599 bp, Saccharomyces cerevisiae
  CDS (1)..(1599)
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 55 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 56 - DNA, 1695 bp, Candida glabrata
  CDS (1)..(1695)
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaataa

SEQ ID NO: 57 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 58 - DNA, 1791 bp, Pichia stipitis
  CDS (1)..(1791)
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagcttag

SEQ ID NO: 59 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSLNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 60 - DNA, 1710 bp, Pichia stipitis
  CDS (1)..(1710)
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaattga

SEQ ID NO: 61 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 62 - DNA, 1692 bp, Kluyveromyces lactis
  CDS (1)..(1692)
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaactaa

SEQ ID NO: 63 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 64 - DNA, 1716 bp, Yarrowia lipolytica
  CDS (1)..(1716)
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtttag

SEQ ID NO: 65 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 66 - DNA, 1716 bp, Schizosaccharomyces pombe
  CDS (1)..(1716)
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaatga

SEQ ID NO: 67 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 68 - DNA, 1176 bp, Saccharomyces cerevisiae
  CDS (1)..(1176)
atgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 69 - protein, 391 aa, Saccharomyces cerevisiae
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 70 - DNA, 1323 bp, Saccharomyces cerevisiae
  CDS (1)..(1323)
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 71 - protein, 440 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 72 - DNA, 1113 bp, Pichia stipitis
  CDS (1)..(1113)
atgaccgctactactattccttacaacatcccttcgcgtttcagaattgcaattatcggctccgggaactggggtacggccgtcgccaaaatcgtatctgaaaacacagctgaaaaatcggatatcttcgagcccatcgttaagatgtgggtttttgaagaagatgtccagggaagaaaattgacggaaatcataaacaatgaccacgaaaatgtccgttatttgccaggagtgcaattgccagaaaacttggtagccgtcccagacatcgtcgacacagttaaagatgctgatttgctcattttcaacgttccacaccagtttttgggcagaatctgcaagcaattgatcggcaaagtttctccatctgtgagagctatctcgtgtttgaaaggtttggaagtcaattccgacggctgcaaattgttgtctcaagtagtcacagacactttgggaatctactgtggtgtcttgtctggagccaacatcgccaatgaagttgctagacaaagatggtccgaaacctcaatcgcatatacagctccaaaggacttccgtggtcctggactcgacattgacgatttcgtcttgaaacaagctttccacagaccttacttccacgttagagttattgaagatgtcattggtgcttctatagctggtgctctcaagaatgtcgtggccattgcagtgggtctcgtagaaggcgctggatggggtgacaatgccaaggctgctatcatgagaattggtatcaaggaaactatccggtttgcttcttactacaagaagtttggcatcagaggcgcagctccagagcccactacatttacagaagaaagtgccggtgtggccgatcttatcactacatgttccgggggtagaaacgtcaaggtcgccagatacatggtcgaaaatggtgtcgatgcctgggaagctgaaaagatattgttgaacgggcagagttcacaaggtatcttgactgcaaaggaagtgcacgagctcttggagaactttgacttgaaggaggaattccccttgttcgaagcaacttatgcggtaatttaccaaaaccattctgtggacgacttcccagcattgttggagtgttaa

SEQ ID NO: 73 - protein, 370 aa, Pichia stipitis
MTATTIPYNIPSRFRIAIIGSGNWGTAVAKIVSENTAEKSDIFEPIVKMWVFEEDVQGRKLTEIINNDHENVRYLPGVQLPENLVAVPDIVDTVKDADLLIFNVPHQFLGRICKQLIGKVSPSVRAISCLKGLEVNSDGCKLLSQVVTDTLGIYCGVLSGANIANEVARQRWSETSIAYTAPKDFRGPGLDIDDFVLKQAFHRPYFHVRVIEDVIGASIAGALKNVVAIAVGLVEGAGWGDNAKAAIMRIGIKETIRFASYYKKFGIRGAAPEPTTFTEESAGVADLITTCSGGRNVKVARYMVENGVDAWEAEKILLNGQSSQGILTAKEVHELLENFDLKEEFPLFEATYAVIYQNHSVDDFPALLEC

SEQ ID NO: 74 - DNA, 1176 bp, Pichia stipitis
  CDS (1)..(1176)
atgtctacgcctgttgcccgtttggcccaactagccaacattttggcacctaatcccaccgcagcatacgctgcacatctgcaccacccagaggcctccttgtctccagaacaccctttccgtgttgctgtgatcggctcgggtaactgggggacgaccatagctaaagtgatcgccgaaaacgctgcggcaagaccccgtttgttccgtcaccaagtcaatatgtgggtgcacgatgaaatcatcgatggtgaaaaattgactcacatcatcaacaccagacacgaaaacgtcaagtacttgcccggtgtgatcttgccgagaaacatcagagccgaagcagatatcggcaatgtagtccatgacgccgacttgattgtctttaacttgcctcatcagttcttgccccgtgtagtcaaatcgttgaagggtaagataaagcacggtgccagagccatctcgtgcttgaagggtttggaagtgactccagaaggctgcaaattgttgtctacctacatcacggaagagttaggcatcgtttgcggtgctctcagtggtgccaacattgctccagaagttgctagatgcaaatggtcagagactaccgtagcctacaagctcccagaggacttcagaggtgcgggtaaggacatcgacaagttcgtgttgagagcatgtttccacagaccctacttccacgtcaatgttatcgaggatgttgccggtgtatctgtagctggagctttgaagaatgtggttgctttagctgtaggatttgtagagggcttgggctggggtgacaacgctaaggctgctgtcatgagagtaggattgttggagacgatcaagttctcagaaacattcttccctgagtccattgcatccactttcacagccgagtcggctggtgtagctgatttgatcacatcatgctctggtggtagaaatgtgaaagtcggtagatacatggcccaaaccggatcttcggccgaaaacgctgaaaagatgttattgaacggccagagctcccagggtatcgtaactgttcgtgaagttcacgacttgttgaccaacgtaggcatgctcgacaaattccccttgtttgaagctacctatcaaatcatctatggctcagagtccatcgaaaacttgcctctcttgttagtaggagaataa

SEQ ID NO: 75 - protein, 391 aa, Pichia stipitis
MSTPVARLAQLANILAPNPTAAYAAHLHHPEASLSPEHPFRVAVIGSGNWGTTIAKVIAENAAARPRLFRHQVNMWVHDEIIDGEKLTHIINTRHENVKYLPGVILPRNIRAEADIGNVVHDADLIVFNLPHQFLPRVVKSLKGKIKHGARAISCLKGLEVTPEGCKLLSTYITEELGIVCGALSGANIAPEVARCKWSETTVAYKLPEDFRGAGKDIDKFVLRACFHRPYFHVNVIEDVAGVSVAGALKNVVALAVGFVEGLGWGDNAKAAVMRVGLLETIKFSETFFPESIASTFTAESAGVADLITSCSGGRNVKVGRYMAQTGSSAENAEKMLLNGQSSQGIVTVREVHDLLTNVGMLDKFPLFEATYQIIYGSESIENLPLLLVGE

SEQ ID NO: 76 - DNA, 1236 bp, Kluyveromyces thermotolerans
  CDS (1)..(1236)
atgttttcaatctccagaatcactagaacttctagtttcactacacagtttagagcgctataccgttttaaacactcagcaaggaaactccagagcatccctttcagcatatacaagaaaatgtccgctgccgacagactgaatcagacccacgacatcctatccgaatccgtgcaagccgtggaaaaccctttcaaagtcaccgtgattgggtccggtaactggggtaccaccatctccaaggttgtggccgagaacgctgcgctaagaccacacttgttcgtcaagcgtgtcgacatgtgggtgtttgaggagaccgtcgacggccagaagttgaccgagatcatcaacaccaagcaccagaacgtcaagtacctgcctaacatcgacctgccagagaacctggtcgccaacccagacttggtctctgccgtcaaggacgccgacatcctggtcttcaacatccctcaccagttcttgccacgcattgtctcccagttgcagggcaacatcaagaaggacgcccgtgccatctcctgtttgaagggtttcgacgtgtccaaggacggtgtcaagctgctatccacctacgtcaccgagaagctcggaatcacctgtggtgccctttccggtgctaacttggccccagaggttgccaaggagaactggtccgagaccactgttgcctacgagttgccaaaggacttcaagggcgagggcaaggacgtcgaccacgccgtcttgaaggctttgttccacagaccatacttccacgtcaacgtcattgacgatgtcgctggtatctctgttgccggtgccttgaagaacgttgtcgctctaggttgcggtttcgtcgagggtctaggctggggtaacaacgcctccgctgccatccagagagttggtttgggtgagatcatcaagttcggtcagatgttcttcccagactcccgtgtcgagacctactaccaggagtccgccggtgttgctgacttgatcaccacctgctctggtggtagaaacgtcagagtcgccacccacatggccaagactggtaagtctgccgaggagtgcgagaaggagctgttgaacggccagtccgcccaggtattcacacatgtaaggaggtccacgagtggttggccgagtgcggtaagaccgatgaattcgttctgttcgaggccgtttaccagattgtctacgagaacgctcctatggacactttgccagacatga

SEQ ID NO: 77 - protein, 411 aa, Kluyveromyces thermotolerans
MFSISRITRTSSFTTQFRALYRFKHSARKLQSIPFSIYKKMSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 78 - DNA, 1158 bp, Schizosaccharomyces pombe
  CDS (1)..(1158)
atgtctggatatggtcaacaaggtgtttctgctgccaacatcgacagcatccgccccaagaaacgtttgtcaattggtgtagttggctccggtaactggggtactgccattgccaagatttgcggtgaaaatgcccgtgcccacggtcaccatttcagaagtaaggtccgcatgtgggtctttgaggaggagattgagtacaagggtgagaagagaaagctcaccgaagtattcaacgaagctcacgagaatgtcaaatacttacccggcatcgaatgccctcccaacgttattgccgtccccgatgttcgtgaggtcgctagacgtgccgacatccttgtctttgtcgttcctcatcaatttattgaacgcgtttgcgaccaaatggtcggtctcattcgccctggtgccgttggtatttcctgtatcaagggtgttgctgtcagcaaggaaggcgtccgcctttactctgaggttatcagcgagaaactcggtatttactgtggtgttctttctggtgctaacgttgcaaacgaagttgcccgtgagcaattctgtgagactactattggtttcaaccctcctaatgaagttgatatccctcgcgagcaaatcgccgccgtctttgatcgcccttacttctcagttgtctccgttgacgacgttgccggtgtcgccttgggtggtgctttgaagaacgtagttgccatggccgttggtttcgctgatggtttggaatggggcggtaataccaaggccgctattatgcgtcgtggtttgttggagatgcaaaagtttgctactaccttcttcgactctgatcctcgtaccatggttgagcaatcttgcggtatcgctgacttggtcacttcttgtttgggtggccgtaacaatcgttgtgctgaagcatttgtcaagactggtaaatctttagagacgcttgaaaaagagctcttaggtggtcaacttcttcaaggagctgccacttccaaggatgttcatgaattccttctcaccaaggatatggtcaaggatttccccttgttcactgccgtttataacatttcctatgaagacatggatcccaaggatttgatcatcgtccttcaaccccttaaggaggactctgagaacgagggcggtactgaaaccgagtaa

SEQ ID NO: 79 - protein, 385 aa, Schizosaccharomyces pombe
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 80 - DNA, 1122 bp, Schizosaccharomyces pombe
  CDS (1)..(1122)
atgactgtggctgctttgaacaaactcagcgctctctccggaagtattcaaaaatctttttcacctaaacttatttctgttggtatcatcggatcaggaaattggggaaccgctattgctaaaatatgtggtgaaaatgccaaggctcatcctgatattttccatcctcaagtacacatgtggatgtatgaagagaagattcaacatgagggaaaagagtgcaatctcacggaagtttttaacactactcatgaaaacgttaaatatctcaaaggtatcaaatgcccttctaacgtcttcgcaaacccggacattcgtgatgtaggttcacgtagcgacattctggtatgggttctccctcaccagttcgttgtgcgtatttgcaatcaattgaagggatgcctaaagaaggatgctgttgcaatttcatgcatcaaaggtgtatctgtcaccaaggaccgtgttcgcctcttttctgatattatcgaagaaaacacgggaatgtattgtggcgttctctctggcgccaacattgccagcgaagttgctcaagagaagttttgcgaaactactatcggatatttgcctaatagttctgttaatccccgctatactcctaagactatccaagctttgtttaaccgtccctacttccgtgtcaacattgttgaggatgttcctggtgttgctttgggcggtgcactcaagaatatcgtcgctgtcgctgccggtattattgatggacttgaattgggagataataccaaatctgctgttatgcgcattggccttctggaaatgcagaaattcggcaggatgtttttcgattgtaagcctcttactatgagcgaggaatcttgtggcatagccgatttaattacaacttgcttaggcggccgtaaccacaaatgcgctgtggcatttgtcaagacaggaaagcccatgcatgttgttgaacaagaacttcttgatggtcagaagttgcaaggtgcagctaccgcgaaggaggtttatgagttccttgataaccagaataaggtaagcgaattcccattgtttacagctgtttatcgcattgtttatgagggacttccacctaataagcttctggaggctatttaa

SEQ ID NO: 81 - protein, 373 aa, Schizosaccharomyces pombe
MTVAALNKLSALSGSIQKSFSPKLISVGIIGSGNWGTAIAKICGENAKAHPDIFHPQVHMWMYEEKIQHEGKECNLTEVFNTTHENVKYLKGIKCPSNVFANPDIRDVGSRSDILVWVLPHQFVVRICNQLKGCLKKDAVAISCIKGVSVTKDRVRLFSDIIEENTGMYCGVLSGANIASEVAQEKFCETTIGYLPNSSVNPRYTPKTIQALFNRPYFRVNIVEDVPGVALGGALKNIVAVAAGIIDGLELGDNTKSAVMRIGLLEMQKFGRMFFDCKPLTMSEESCGIADLITTCLGGRNHKCAVAFVKTGKPMHVVEQELLDGQKLQGAATAKEVYEFLDNQNKVSEFPLFTAVYRIVYEGLPPNKLLEAI

SEQ ID NO: 82 - DNA, 1014 bp, artificial sequence
  Mutant of Pseudomonas fluorescens ilvC coding region
atgaaggtgttttacgataaagactgcgatctgagcatcatccagggaaagaaggttgctattataggatatggttcccaaggacacgcacaagccttgaacttgaaagattctggggtcgacgtgacagtaggtctgtataaaggtgctgctgatgcagcaaaggctgaagcacatggctttaaagtcacagatgttgcagcggctgttgctggcgctgatttagtcatgattttaattccagatgaatttcaatcgcaattgtacaaaaatgaaatagaaccaaacattaagaagggcgctaccttggccttcagtcatggatttgccattcattacaatcaagtagtccccagggcagatttggacgttattatgattgcacctaaggctccggggcatactgttaggagcgaatttgttaagggtggtggtattccagatttgatcgctatataccaagacgttagcggaaacgctaagaatgtagctttaagctacgcagcaggagttggtggcgggagaacgggtataatagaaaccacttttaaagacgagactgagacagatttatttggagaacaagcggttctgtgcggaggaactgttgaattggttaaagcaggctttgagacgcttgtcgaagcagggtacgctcccgaaatggcatacttcgaatgtctacatgaattgaagttgatagtagacttaatgtatgaaggtggtatagctaatatgaactattccatttcaaataatgcagaatatggtgagtatgtcaccggacctgaagtcattaacgcagaatcaagacaagccatgagaaatgccttgaaacgtatccaggacggtgaatacgctaagatgttcataagtgaaggcgctacgggttacccgagtatgactgctaaaagaagaaacaatgcagcacatggtatcgaaattattggtgaacagttaaggtctatgatgccctggatcggtgctaataagatcgtagacaaggcgaaaaat

SEQ ID NO: 83 - protein, 338 aa, artificial sequence
  mutant of Pseudomonas fluorescens protein
MKVFYDKDCDLSIIQGKKVAIIGYGSQGHAQALNLKDSGVDVTVGLYKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAAVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 84 - DNA, 1644 bp, artificial sequence
  Bacillus subtilis kivD coding region codon optimized for expression is S. cerevisiae
atgtatacagtaggtgactatctgttggacagattacacgaattaggtatagaagaaatattcggagtaccaggtgactacaatttgcaatttctagatcaaattatttcacacaaagatatgaaatgggtgggaaatgctaatgagttaaatgcctcctatatggccgacgggtacgcaagaacgaaaaaggctgcggcattcttgactacatttggtgttggcgaattatccgcagttaatggcttagcgggctcctatgctgagaacctgcctgttgttgagatcgtgggatctcctacctcgaaagtgcagaacgaaggtaagtttgttcaccatacgttggctgatggtgatttcaagcactttatgaagatgcacgaaccggttactgctgccaggactttattgacagccgagaatgcaactgttgaaattgatagagtgttgtctgccttactaaaggaaagaaagccggtttacatcaatttacctgtagatgtagctgccgctaaggctgaaaaaccatccttgcctcttaagaaggaaaattccacgtcgaatacatctgatcaagagattctgaacaaaatacaggaaagtctgaagaatgccaagaaaccaattgtaatcacaggccatgaaattatatcgttcggcctagagaagactgttactcagtttatttcaaagactaagttacctattactactttgaactttggtaaatcatctgttgatgaagcattgccctcatttttggggatttacaacggtactctgtcagagccaaacttgaaggaatttgtggaatctgctgattttattcttatgttgggtgtaaagcttaccgattctagtacgggtgcatttactcaccatcttaatgaaaataaaatgatttccttgaatatcgatgaaggtaaaattttcaacgaaagaatccaaaatttcgacttcgaatccctgatatcatctcttcttgacttgtccgaaattgaatataaaggcaagtacatagataaaaagcaagaagattttgtaccttctaacgcgctgttgtcacaagatagactgtggcaagctgtcgaaaatttgacccaaagtaatgagacgatcgtggctgaacaaggcacttctttcttcggtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagc

SEQ ID NO: 85 - protein, 548 aa, Bacillus subtilis; identical to SEQ ID NO: 48

SEQ ID NO: 86 - DNA, 1125 bp, artificial sequence
  horse ADH coding region codon optimized for S. cerevisiae expression
atgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttt

SEQ ID NO: 87 - protein, 375 aa, Equus caballus
MSTAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 88 - DNA, 1713 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaa

SEQ ID NO: 89 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 90 - DNA, 38 bp, Artificial Sequence
  primer BK468
gcctcgagttttaatgttacttctcttgcagttaggga

SEQ ID NO: 91 - DNA, 20 bp, Artificial Sequence
  primer N98SeqF1
cgtgttagtcacatcaggac

SEQ ID NO: 92 - DNA, 20 bp, Artificial Sequence
  primer N98SeqF4
ggtttctgtctctggtgacg

SEQ ID NO: 93 - DNA, 22 bp, Artificial Sequence
  primer N99SeqR2
catcgactgcattacgcaactc

SEQ ID NO: 94 - DNA, 22 bp, Artificial Sequence
  primer N160SeqF5
cctgaagtctaggtccctattt

SEQ ID NO: 95 - DNA, 38 bp, Artificial Sequence
  primer N191
atccgcggatagatctcccattaccgacatttgggcgc

SEQ ID NO: 96 - DNA, 30 bp, Artificial Sequence
  primer N1110
gcgatttaatctctaattattagttaaagt

SEQ ID NO: 97 - DNA, 30 bp, Artificial Sequence
  primer N1111
tatttgtatcgaggtgtctagtcttctatt

SEQ ID NO: 98 - DNA, 22 bp, Artificial Sequence
  primer oBP512
aaagttggcatagcggaaactt

SEQ ID NO: 99 - DNA, 22 bp, Artificial Sequence
  primer oBP594
agctgtctcgtgttgtgggttt

SEQ ID NO: 100 - DNA, 49 bp, Artificial Sequence
  primer oBP595
cttaataatagaacaatatcatcctttacgggcatcttatagtgtcgtt

SEQ ID NO: 101 - DNA, 49 bp, Artificial Sequence
  primer oBP596
gcgccaacgacactataagatgcccgtaaaggatgatattgttctatta

SEQ ID NO: 102 - DNA, 49 bp, Artificial Sequence
  primer oBP597
tatggaccctgaaaccacagccacattgcaacgacgacaatgccaaacc

SEQ ID NO: 103 - DNA, 49 bp, Artificial Sequence
  primer oBP598
tccttggtttggcattgtcgtcgttgcaatgtggctgtggtttcagggt

SEQ ID NO: 104 - DNA, 49 bp, Artificial Sequence
  primer oBP599
atcctctcgcggagtccctgttcagtaaaggccatgaagctttttcttt

SEQ ID NO: 105 - DNA, 49 bp, Artificial Sequence
  primer oBP600
attggaaagaaaaagcttcatggcctttactgaacagggactccgcgag

SEQ ID NO: 106 - DNA, 22 bp, Artificial Sequence
  primer oBP601
tcataccacaatcttagaccat

SEQ ID NO: 107 - DNA, 21 bp, Artificial Sequence
  primer oBP602
tgttcaaacccctaaccaacc

SEQ ID NO: 108 - DNA, 22 bp, Artificial Sequence
  primer oBP603
tgttcccacaatctattaccta

SEQ ID NO: 109 - DNA, 21 bp, Artificial Sequence
  primer oBP605
tactgaacagggactccgcga

SEQ ID NO: 110 - DNA, 21 bp, Artificial Sequence
  primer oBP606
tcataccacaatcttagacca

SEQ ID NO: 111 - DNA, 34 bp, Artificial Sequence
  primer oBP562
aattgtttaaacatgtatacagtaggtgactatc

SEQ ID NO: 112 - DNA, 49 bp, Artificial Sequence
  primer oBP563
aatcataaatcataagaaattcgcttatcagctcttgttttgttctgca

SEQ ID NO: 113 - DNA, 49 bp, Artificial Sequence
  primer oBP564
ttatttgcagaacaaaacaagagctgataagcgaatttcttatgattta

SEQ ID NO: 114 - DNA, 34 bp, Artificial Sequence
  primer oBP565
aattggccggccaaaaaaagcatgcacgtataca

SEQ ID NO: 115 - DNA, 32 bp, Artificial Sequence
  primer oBP505
aattgagctcactgtagccctagacttgatag

SEQ ID NO: 116 - DNA, 35 bp, Artificial Sequence
  primer oBP506
aattggcgcgcctgtatatgagatagttgattgta

SEQ ID NO: 117 - DNA, 35 bp, Artificial Sequence
  primer oBP507
aattttaattaagtctaggttctttggctgttcaa

SEQ ID NO: 118 - DNA, 33 bp, Artificial Sequence
  primer oBP508
aattgtcgactttagaagtgtcaacaacgtatc

SEQ ID NO: 119 - DNA, 34 bp, Artificial Sequence
  primer oBP674
aattggcgcgccaattaccgtcgctcgtgatttg

SEQ ID NO: 120 - DNA, 34 bp, Artificial Sequence
  primer oBP675
aattgtttaaacttgaatatgtattacttggtta

SEQ ID NO: 121 - DNA, 22 bp, Artificial Sequence
  primer oBP495
ggagatatacaatagaacagat

SEQ ID NO: 122 - DNA, 22 bp, Artificial Sequence
  primer oBP496
tagcaatggggtttttttcagt

SEQ ID NO: 123 - DNA, 47 bp, Artificial Sequence
  primer T-FBA1(SalI)
attctacgtacgtcgacgcctacttggcttcacatacgttgcatacg

SEQ ID NO: 124 - DNA, 49 bp, Artificial Sequence
  primer B-FBA1(SpeI)
gtatcaaatactagtttgaatatgtattacttggttatggttatatatg

SEQ ID NO: 125 - DNA, 43 bp, Artificial Sequence
  primer T-U/PGK1(KpnI)
actacagatggtaccaattaccgtcgctcgtgatttgtttgca

SEQ ID NO: 126 - DNA, 45 bp, Artificial Sequence
  primer B-U/PGK1(SalI)
agcatccttgtcgacaggaccttgttgtgtgacgaaattggaagc

SEQ ID NO: 127 - DNA, 22 bp, Artificial Sequence
  primer oBP556
tattttcgaggaccttgtcacc

SEQ ID NO: 128 - DNA, 25 bp, Artificial Sequence
  primer oBP561
tggccattaatctttcccatattag

SEQ ID NO: 129 - DNA, 725 bp, Artificial Sequence
  UAS(PGK1)-FBA1p
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 130 - DNA, 10494 bp, Artificial Sequence
  pWS358-PGK1p-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaactagtatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatactccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 131 - DNA, 7589 bp, Artificial Sequence
  pUC19-kan::pdc1::FBA-alsS::TRX1 (clone A)
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 132 - DNA, 9593 bp, Artificial Sequence
  pYZ090 alsS
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 133 - DNA, 12896 bp, Artificial Sequence
  pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 134 - DNA, 11856 bp, Artificial sequence
  Plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 135 - DNA, 15539 bp, Artificial sequence
  Plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 136 - DNA, 4586 bp, Artificial sequence
  Template
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 137 - DNA, 80 bp, Artificial sequence
  Primer
ttccggtttctttgaaatttttttgattcggtaatctccgagcagaaggagcattgcggattacgtattctaatgttcag

SEQ ID NO: 138 - DNA, 81 bp, Artificial sequence
  Primer
gggtaataactgatataattaaattgaagctctaatttgtgagtttagtacaccttggctaactcgttgtatcatcactgg

SEQ ID NO: 139 - DNA, 38 bp, Artificial sequence; identical to SEQ ID NO: 90
  Primer

SEQ ID NO: 140 - DNA, 31 bp, Artificial sequence
  Primer
gctaaattcgagtgaaacacaggaagaccag

SEQ ID NO: 141 - DNA, 24 bp, Artificial sequence
  Primer
ttctcgacgtgggcctttttcttg

SEQ ID NO: 142 - DNA, 49 bp, Artificial sequence
  Primer
tgcagctttaaataatcggtgtcactactttgccttcgtttatcttgcc

SEQ ID NO: 143 - DNA, 49 bp, Artificial sequence
  Primer
gagcaggcaagataaacgaaggcaaagtagtgacaccgattatttaaag

SEQ ID NO: 144 - DNA, 49 bp, Artificial sequence
  Primer
tatggaccctgaaaccacagccacattgtaaccaccacgacggttgttg

SEQ ID NO: 145 - DNA, 49 bp, Artificial sequence
  Primer
tttagcaacaaccgtcgtggtggttacaatgtggctgtggtttcagggt

SEQ ID NO: 146 - DNA, 49 bp, Artificial sequence
  Primer
ccagaaaccctatacctgtgtggacgtaaggccatgaagctttttcttt

SEQ ID NO: 147 - DNA, 49 bp, Artificial sequence
  Primer
attggaaagaaaaagcttcatggccttacgtccacacaggtatagggtt

SEQ ID NO: 148 - DNA, 22 bp, Artificial sequence
  Primer
cataagaacacctttggtggag

SEQ ID NO: 149 - DNA, 22 bp, Artificial sequence
  Primer
aggattatcattcataagtttc

SEQ ID NO: 150 - DNA, 23 bp, Artificial sequence
  Primer
ttcttggagctgggacatgtttg

SEQ ID NO: 151 - DNA, 22 bp, Artificial sequence
  Primer
tgatgatatttcataaataatg

SEQ ID NO: 152 - DNA, 23 bp, Artificial sequence
  Primer
atgcgtccatctttacagtcctg

SEQ ID NO: 153 - DNA, 22 bp, Artificial sequence
  Primer
tacgtacggaccaatcgaagtg

SEQ ID NO: 154 - DNA, 49 bp, Artificial sequence
  Primer
aattcgtttgagtacactactaatggctttgttggcaatatgtttttgc

SEQ ID NO: 155 - DNA, 49 bp, Artificial sequence
  Primer
atatagcaaaaacatattgccaacaaagccattagtagtgtactcaaac

SEQ ID NO: 156 - DNA, 49 bp, Artificial sequence
  Primer
tatggaccctgaaaccacagccacattcttgttatttataaaaagacac

SEQ ID NO: 157 - DNA, 49 bp, Artificial sequence
  Primer
ctcccgtgtctttttataaataacaagaatgtggctgtggtttcagggt

SEQ ID NO: 158 - DNA, 49 bp, Artificial sequence
  Primer
taccgtaggcgtccttaggaaagatagaaggccatgaagctttttcttt

SEQ ID NO: 159 - DNA, 49 bp, Artificial sequence
  Primer
attggaaagaaaaagcttcatggccttctatctttcctaaggacgccta

SEQ ID NO: 160 - DNA, 21 bp, Artificial sequence
  Primer
ttattgtttggcatttgtagc

SEQ ID NO: 161 - DNA, 22 bp, Artificial sequence
  Primer
ccaagcatctcataaacctatg

SEQ ID NO: 162 - DNA, 22 bp, Artificial sequence
  Primer
tgtgcagatgcagatgtgagac

SEQ ID NO: 163 - DNA, 17 bp, Artificial sequence
  Primer
agttattgataccgtac

SEQ ID NO: 164 - DNA, 19 bp, Artificial sequence
  Primer
cgagataccgtaggcgtcc

SEQ ID NO: 165 - DNA, 2237 bp, Artificial sequence
  Fragment
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattatt

SEQ ID NO: 166 - DNA, 24 bp, Artificial sequence
  Primer
ttatgtatgctcttctgacttttc

SEQ ID NO: 167 - DNA, 49 bp, Artificial sequence
  Primer
aataattagagattaaatcgctcattttttgccagtttcttcaggcttc

SEQ ID NO: 168 - DNA, 49 bp, Artificial sequence
  Primer
agcctgaagaaactggcaaaaaatgagcgatttaatctctaattattag

SEQ ID NO: 169 - DNA, 49 bp, Artificial sequence
  Primer
tatggaccctgaaaccacagccacatttttcaatcattggagcaatcat

SEQ ID NO: 170 - DNA, 49 bp, Artificial sequence
  Primer
taaaatgattgctccaatgattgaaaaatgtggctgtggtttcagggtc

SEQ ID NO: 171 - DNA, 49 bp, Artificial sequence
  Primer
accgtaggtgttgtttgggaaagtggaaggccatgaagctttttctttc

SEQ ID NO: 172 - DNA, 49 bp, Artificial sequence
  Primer
ttggaaagaaaaagcttcatggccttccactttcccaaacaacacctac

SEQ ID NO: 173 - DNA, 23 bp, Artificial sequence
  Primer
ttattgcttagcgttggtagcag

SEQ ID NO: 174 - DNA, 4420 bp, Artificial sequence
  Cassette
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaaaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 175 - DNA, 21 bp, Artificial sequence
  Primer
tttttggtggttccggcttcc

SEQ ID NO: 176 - DNA, 22 bp, Artificial sequence
  Primer
aaagttggcatagcggaaactt

SEQ ID NO: 177 - DNA, 16 bp, Artificial sequence
  Primer
gtcattgacaccatct

SEQ ID NO: 178 - DNA, 19 bp, Artificial sequence
  Primer
agagataccgtaggtgttg

SEQ ID NO: 179 - DNA, 57 bp, Artificial sequence
  Primer
aattggatccggcgcgccgtttaaacggccggccaatgtggctgtggtttcagggtc

SEQ ID NO: 180 - DNA, 49 bp, Artificial sequence
  Primer
aatttctagattaattaagcggccgcaaggccatgaagctttttctttc

SEQ ID NO: 181 - DNA, 2686 bp, Artificial sequence
  Plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 182 - DNA, 21 bp, Artificial sequence
  Primer
tcggtgcgggcctcttcgcta

SEQ ID NO: 183 - DNA, 21 bp, Artificial sequence
  Primer
aatgtgagttagctcactcat

SEQ ID NO: 184 - DNA, 15456 bp, Artificial sequence
  Template
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 185 - DNA, 33 bp, Artificial sequence
  Primer
aattggcgcgccatgaaagctctggtttatcac

SEQ ID NO: 186 - DNA, 49 bp, Artificial sequence
  Primer
tgaatcatgagttttatgttaattagctcaggcagcgcctgcgttcgag

SEQ ID NO: 187 - DNA, 49 bp, Artificial sequence
  Primer
atcctctcgaacgcaggcgctgcctgagctaattaacataaaactcatg

SEQ ID NO: 188 - DNA, 34 bp, Artificial sequence
  Primer
aattgtttaaacaagtaaataaattaatcagcat

SEQ ID NO: 189 - DNA, 49 bp, Artificial sequence
  Primer
acacaatacaataacaagaagaacaaaatgaaagctctggtttatcacg

SEQ ID NO: 190 - DNA, 49 bp, Artificial sequence
  Primer
agcgtatacatctgttgggaaagtagaaggccatgaagctttttctttc

SEQ ID NO: 191 - DNA, 49 bp, Artificial sequence
  Primer
ttggaaagaaaaagcttcatggccttctactttcccaacagatgtatac

SEQ ID NO: 192 - DNA, 22 bp, Artificial sequence
  Primer
ttattgtttagcgttagtagcg

SEQ ID NO: 193 - DNA, 3521 bp, Artificial sequence
  Cassette
aaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttctactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 194 - DNA, 72 bp, Artificial sequence
  Primer
cataatcaatctcaaagagaacaacacaatacaataacaagaagaacaaaatgaaagctctggtttatcacg

SEQ ID NO: 195 - DNA, 21 bp, Artificial sequence
  Primer
taggcataatcaccgaagaag

SEQ ID NO: 196 - DNA, 21 bp, Artificial sequence
  Primer
aaaatggtaagcagctgaaag

SEQ ID NO: 197 - DNA, 17 bp, Artificial sequence
  Primer
agttgttagaactgttg

SEQ ID NO: 198 - DNA, 22 bp, Artificial sequence
  Primer
cttagcctctagccatagccat

SEQ ID NO: 199 - DNA, 1685 bp, Artificial sequence
  Cassette
gtattttggtagattcaattctctttccctttccttttccttcgctccccttccttatcagcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgacactctccccccccctccccctctgatctttcctgttgcctctttttcccccaaccaa

SEQ ID NO: 200 - DNA, 1559 bp, Artificial sequence
  Template
gcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtg

SEQ ID NO: 201 - DNA, 90 bp, Artificial sequence
  Primer
gtattttggtagattcaattctctttccctttccttttccttcgctccccttccttatcagcattgcggattacgtattctaatgttcag

SEQ ID NO: 202 - DNA, 90 bp, Artificial sequence
  Primer
ttggttgggggaaaaagaggcaacaggaaagatcagagggggagggggggggagagtgtcaccttggctaactcgttgtatcatcactgg

SEQ ID NO: 203 - DNA, 23 bp, Artificial sequence
  Primer
ttagttttgctggccgcatcttc

SEQ ID NO: 204 - DNA, 7523 bp, Artificial sequence
  Plasmid
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 205 - DNA, 21 bp, Artificial sequence
  Primer
cccattaatatactattgaga

SEQ ID NO: 206 - DNA, 8366 bp, Artificial Sequence
  pRS316-UAS(PGK1)-PFBA1-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 207 - DNA, 62 bp, Artificial Sequence
  N1176 Primer
gcatagcaatctaatctaagttccagctgaggatgacaacagattactcatcaccagcatat

SEQ ID NO: 208 - DNA, 62 bp, Artificial Sequence
  N1177 Primer
atcaacacacaaacactaaatcaaagctgaggatggatttatttgagtcattagcacaaaaa

SEQ ID NO: 209 - DNA, 44 bp, Artificial Sequence
  N822 Primer
cgcctcagctttgatttagtgtttgtgtgttgataagcagttgc

SEQ ID NO: 210 - DNA, 63 bp, Artificial Sequence
  N1178 Primer
ggtatcgataagcttgatatcgaattcctgcgcccgggccactagtcagatgccgcgggcact

SEQ ID NO: 211 - DNA, 10934 bp, Artificial Sequence
  pRS423::TEF(M4)-xpk1+ENO1-eutD plasmid
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcgcccgggccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 212 - DNA, 38 bp, Artificial Sequence
  N821 Primer
cgcccgggccactagtcagatgccgcgggcacttgagc

SEQ ID NO: 213 - DNA, 30 bp, Artificial Sequence
  N1115 Primer
tttttgtgctaatgactcaaataaatccat

SEQ ID NO: 214 - DNA, 30 bp, Artificial Sequence; identical to SEQ ID NO: 96
  N1110 Primer

SEQ ID NO: 215 - DNA, 30 bp, Artificial Sequence
  N1114 Primer
atatgctggtgatgagtaatctgttgtcat

SEQ ID NO: 216 - DNA, 22 bp, Artificial Sequence
  N160SeqF5 Primer
cctgaagtctaggtccctattt

SEQ ID NO: 217 - DNA, 38 bp, Artificial Sequence; identical to SEQ ID NO: 90
  BK468 Primer

SEQ ID NO: 218 - DNA, 9220 bp, Artificial Sequence
  pUC19-URA3::pdc1::TEF(M4)-xpk1::kan Plasmid
ccgcattgcggattacgtattctaatgttcagataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatccagtgatgatacaacgagttagccaaggtgggggatcctctagagtcttaaggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgcggtggttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttttatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaa

SEQ ID NO: 219 - DNA, 20 bp, Artificial Sequence
  N886 Primer
caatgattgttggtaaaggg

SEQ ID NO: 220 - DNA, 30 bp, Artificial Sequence
  N1214 Primer
aaaaagggggtagaagcgttttgaagctat

SEQ ID NO: 221 - DNA, 22 bp, Artificial Sequence
  oBP512 Primer
aaagttggcatagcggaaactt

SEQ ID NO: 222 - DNA, 19 bp, Artificial Sequence
  N160SeqR5 Primer
tgagcccgaaagagaggat

SEQ ID NO: 223 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 224 - protein, 343 aa, Artificial sequence
  Anaerostipes caccae KARI variant K9D3
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 225 - protein, 343 aa, Artificial sequence
  Anaerostipes caccae KARI variant K9G9
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 226 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 227 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 228 - protein, 690 aa, Saccharomyces cerevisiae
MEGFNPADIEHASPINSSDSHSSSFVYALPKSASEYVVNHNEGRASASGNPAAVPSPIMTLNLKSTHSLNIDQHVHTSTSPTETIGHIHHVEKLNQNNLIHLDPVPNFEDKSDIKPWLQKIFYPQGIELVIERSDAFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMDNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHSDAANHNNIGVPNNNSHSLNTQHNVSDLGNSLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 229 - DNA, 1251 bp, Saccharomyces cerevisiae
atgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttgtgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaa

SEQ ID NO: 230 - protein, 416 aa, Saccharomyces cerevisiae
MKAKSMKSIISVPISVSKTGKMKLTASPDNLASMMSKDQNKLIHLDPVPSFEDRHEIKPWLQKIFYPQGIDIVIERSDSSKVTFKCRSVRSKVGLNPKSKGSSSRSHACPFRIRAAYSVRLQKWNVVVMNNIHSHELRFDLITKTDDYKKFKENLRQKNDEKAIKTFDELEYKASLNLPLVTPIISCDCGLTKEIEAFNNIFLPLSNPPLTSKKNLLKTNKNSVSKIKSRQMDNSKPRPRLKTKLDADLHDTGFLDNFKTRNSCVKIEKEDSLTNLNEIDFTNMFCNDNFIQNYNQGLMELLTEPTPGPSSSSCILPSTPTRPLSQSKMDIALSESTTSSPNFMETDAPYGDEIIKVSKDTKSNAPTADTDIATNLGKERNENFGMLNYNYEALLHFNDEHFNELNSIDPALISKY

SEQ ID NO: 231 - DNA, 363 bp, Saccharomyces cerevisiae
atgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatga

SEQ ID NO: 232 - protein, 120 aa, Saccharomyces cerevisiae
MTGERIEKVKINDEFAKSHFLTTQWRETKRQRHYKMPVTEQGLRERIESAIPQVYHIIVTDLSYGCGQSFDIVVVSDFFQGKSKLMRSRAVNKAVKEELQEIHAFSCKCYTEEEWSKIVV

SEQ ID NO: 233 - DNA, 858 bp, Saccharomyces cerevisiae
atgtgttcttttcaggttccatctgcattttcttttaactacacctcgtactgttataaacgccaccaagcaagatattacacagcagcaaaactttttcaggaaatgcctgttattgaaattaacgatcaagagcaatttacttacctaactaccactgcggccggcgacaagttaatcgtgctttatttccataccagttgggcagaaccatgcaaagcattaaagcaggtttttgaggccattagtaatgagccttccaattccaacgtctctttcttatccattgatgcggacgaaaactcggaaatttcagaactttttgaaatctcagctgttccatattttatcataattcacaaagggacaatcttaaaagaattatccggcgcggatccaaaggagtatgtgtctttattagaagactgcaagaactcagtcaattccggatcatcacaaactcatactatggaaaatgcaaacgtaaatgaggggagtcataatgatgaagacgatgacgacgaagaagaggaagaagaaactgaggagcaaataaacgctagattgactaaattggtcaatgccgcgccggtaatgttatttatgaaggggagcccctctgaacctaaatgcgggttttcgagacaacttgtgggtatcttgagagaacatcaagtaagatttggcttctttgatatattaagagacgaatctgttagacaaaacttgaaaaagttttctgaatggccaactttccctcaactttatataaatggggagtttcaaggcggtttagacattatcaaggaatccttggaggaagaccctgattttttgcagcatgctctccaatcttaa

SEQ ID NO: 234 - protein, 285 aa, Saccharomyces cerevisiae
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 235 - DNA, 969 bp, Saccharomyces cerevisiae
atgtccattgtagcactaaagaacgcagtggtgacccttatacagaaagcgaaaggtagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcggataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagtcactatcggtggcggttatctacttggtgggctagtaccactagtgccatatttttttgtctcagatgtgggcacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaa

SEQ ID NO: 236 - protein, 322 aa, Saccharomyces cerevisiae
MSIVALKNAVVTLIQKAKGSGGTSELGGSESTPLLRGSNSNSSRHDNLSSSSSDIIYGRNSAQDLENSPMSVGKDNRNGDNGSDNEKANLGFFQSVDPRVISDLIIGLSDGLTVPFALTAGLSSLGDAKLVITGGFAELISGAISMGLGGYLGAKSESDYYHAEVKKEKRKFYDNSNLINREIEDILLEINPNFSDETIVSFIKDLQRTPELMVDFIIRYGRGLDEPAENRELISAVTIGGGYLLGGLVPLVPYFFVSDVGTGLIYSIIVMVVTLFWFGYVKTKLSMGSGSSTSKKVTEGVEMVVVGGVAAGAAWFFVKLLG

SEQ ID NO: 237 - protein, 347 aa, Beijerinkia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 238 - DNA, 719 bp, Artificial sequence
  UAS(PGK1)-FBA1
aattaccgtcgctcgtgatttgtttgcaaaaagaacaaaactgaaaaaacccagacacgctcgacttcctgtcttcctattgattgcagcttccaatttcgtcacacaacaaggtcctgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 239 - DNA, 636 bp, Artificial sequence
  Promoter UAS(PGK1)-ENO2
aattaccgtcgctcgtgatttgtttgcaaaaagaacaaaactgaaaaaacccagacacgctcgacttcctgtcttcctattgattgcagcttccaatttcgtcacacaacaaggtcctgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 240 - DNA, 979 bp, Artificial sequence
  Promoter UAS(FBA1)-PDC1
tgacagcaggattatcgtaatacgtaatagttgaaaatctcaaaaatgtgtgggtcattacgtaaataatgataggaatgggattcttctatttttcctttttccattctcgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 241 - DNA, 994 bp, Artificial sequence
  UAS(PGK1)-PDC1
aattaccgtcgctcgtgatttgtttgcaaaaagaacaaaactgaaaaaacccagacacgctcgacttcctgtcttcctattgattgcagcttccaatttcgtcacacaacaaggtcctgtcgacccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 242 - DNA, 731 bp, Artificial sequence
  UAS(PGK1)-OLE1
aattaccgtcgctcgtgatttgtttgcaaaaagaacaaaactgaaaaaacccagacacgctcgacttcctgtcttcctattgattgcagcttccaatttcgtcacacaacaaggtcctgtcgaccggggcgcccgtgcaaaaactaactccgagcccgggcatgtcccgggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaa

SEQ ID NO: 243 - DNA, 4306 bp, Artificial sequence
  Synthetic construct-pUC19-URA3::ilvD-TRX1
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 244 - DNA, 1772 bp, Artificial sequence
  chimeric construct
  misc_feature (613)..(616): Start codon
  misc_feature (1420)..(1422): Stop codon
cctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatct

SEQ ID NO: 245 - DNA, 1854 bp, Artificial sequence
  Synthetic construct-HincII-KpnI fragment
gactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcgg

SEQ ID NO: 246 - DNA, 11017 bp, Artificial sequence
  Synthetic construct-pRS426::GPD-xpk1+ADH-eutD
gatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcggatagatctagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacgctgaggatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataattaattaatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaattaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatcctcagcgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaag

SEQ ID NO: 247 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 248 - protein, 546 aa, Macrococcus caseolyticus
MKQRIGQYLIDALHVNGVDKIFGVPGDFTLAFLDDIIRHDNVEWVGNTNELNAAYAADGYARVNGLAAVSTTFGVGELSAVNGIAGSYAERVPVIKISGGPSSVAQQEGRYVHHSLGEGIFDSYSKMYAHITATTTILSVDNAVDEIDRVIHCALKEKRPVHIHLPIDVALTEIEIPHAPKVYTHESQNVDAYIQAVEKKLMSAKQPVIIAGHEINSFKLHEQLEQFVNQTNIPVAQLSLGKSAFNEENEHYLGIYDGKIAKENVREYVDNADVILNIGAKLTDSATAGFSYKFDTNNIIYINHNDFKAEDVISDNVSLIDLVNGLNSIDYRNETHYPSYQRSDMKYELNDAPLTQSNYFKMMNAFLEKDDILLAEQGTSFFGAYDLSLYKGNQFIGQPLWGSIGYTFPSLLGSQLADMHRRNILLIGDGSLQLTVQALSTMIRKDIKPIIFVINNDGYTVERLIHGMEEPYNDIQMWNYKQLPEVFGGKDTVKVHDAKTSNELKTVMDSVKADKDHMHFIEVHMAVEDAPKKLIDIAKAFSDANK

What is claimed is:

1. A method comprising:
(a) providing a recombinant host cell comprising an isobutanol biosynthetic pathway wherein said pathway comprises the substrate to product conversion pyruvate to acetolactate catalyzed by a polypeptide encoded by a heterologous polynucleotide integrated into the chromosome at the PDC1-TRX1 intergenic region and wherein said pathway comprises the substrate to product conversion acetolactate to 2,3-dihydroxyisovalerate catalyzed by a polypeptide that has at least about 90% identity to SEQ ID NO: 224 or 225 and said polypeptide is encoded by a polynucleotide on a plasmid and wherein the titer of isobutanol production is increased as compared to a recombinant host cell wherein the polynucleotide encoding a polypeptide that catalyzes the conversion of pyruvate to acetolactate is not integrated into the chromosome;

(b) contacting the host cell with a fermentable carbon substrate to form a fermentation broth under conditions whereby the isobutanol biosynthetic pathway product is produced; and (c) contacting the fermentation broth with an extractant to produce a two-phase fermentation mixture, wherein the extractant comprises fatty acids; and (d) recovering the isobutanol.

2. The method of claim 1, wherein the fatty acids are derived from corn oil or soybean oil.

3. The method of claim 1, wherein the extractant further comprises a water immiscible organic extractant selected from the group consisting of: $C_{12}$ to $C_{22}$ fatty alcohols, esters of $C_{12}$ to $C_{22}$ fatty acids, $C_{12}$ to $C_{22}$ fatty aldehydes, and $C_{12}$ to $C_{22}$ fatty amides.

4. The method of claim 1, and wherein the method further comprises contacting the fermentation broth with an organic acid and an enzyme capable of esterifying the isobutanol with the organic acid.

5. The method of claim 1, and wherein the method further comprises vaporizing at least a portion of the fermentation broth to form a vapor stream comprising water and alcohol.

6. The method of claim 1, wherein the rate of isobutanol production is increased by at least 10% as compared to a recombinant host cell wherein the polynucleotide encoding a polypeptide that catalyzes the conversion of pyruvate to acetolactate is not integrated into the chromosome.

7. The method of claim 1, wherein the titer of isobutanol production is increased by at least 10% as compared to a recombinant host cell wherein the polynucleotide encoding a polypeptide that catalyzes the conversion of pyruvate to acetolactate is not integrated into the chromosome.

* * * * *